US011613576B2

(12) United States Patent
Beil et al.

(10) Patent No.: US 11,613,576 B2
(45) Date of Patent: Mar. 28, 2023

(54) TRISPECIFIC BINDING PROTEINS, METHODS, AND USES THEREOF

(71) Applicant: Sanofi, Paris (FR)

(72) Inventors: Christian Beil, Frankfurt am Main (DE); Jochen Beninga, Frankfurt am Main (DE); Joerg Birkenfeld, Frankfurt am Main (DE); Gary J. Nabel, Cambridge, MA (US); Huawei Qiu, Westborough, MA (US); Ercole Rao, Morfelden-Walldorf (DE); Joerg Regula, Munich (DE); Edward Seung, Cambridge, MA (US); Ronnie Wei, Needman, MA (US); Lan Wu, Cambridge, MA (US); Zhen Xing, Cambridge, MA (US); Ling Xu, Cambridge, MA (US); Zhi-Yong Yang, Cambridge, MA (US); Béatrice Cameron, Paris (FR); Tarik Dabdoubi, Paris (FR); Cendrine Lemoine, Paris (FR); Catherine Prades, Paris (FR)

(73) Assignee: SANOFI, Paris (FR)

( * ) Notice: Subject to any disclaimer, the term of this patent is extended or adjusted under 35 U.S.C. 154(b) by 162 days.

(21) Appl. No.: 16/843,792

(22) Filed: Apr. 8, 2020

(65) Prior Publication Data

US 2020/0399369 A1 Dec. 24, 2020

Related U.S. Application Data

(60) Provisional application No. 62/831,572, filed on Apr. 9, 2019, provisional application No. 62/831,415, filed on Apr. 9, 2019.

(30) Foreign Application Priority Data

Oct. 2, 2019 (EP) .................................... 19306261
Oct. 8, 2019 (EP) .................................... 19306312

(51) Int. Cl.

*C07K 16/28* (2006.01)
*A61K 39/395* (2006.01)
*C07K 16/32* (2006.01)
*A61K 45/06* (2006.01)

(52) U.S. Cl.

CPC ...... *C07K 16/2809* (2013.01); *A61K 39/3955* (2013.01); *A61K 39/39558* (2013.01); *A61K 45/06* (2013.01); *C07K 16/2818* (2013.01); *C07K 16/2896* (2013.01); *C07K 16/32* (2013.01); *C07K 2317/31* (2013.01); *C07K 2317/522* (2013.01); *C07K 2317/524* (2013.01); *C07K 2317/526* (2013.01); *C07K 2317/53* (2013.01); *C07K 2317/565* (2013.01)

(58) Field of Classification Search

None

See application file for complete search history.

(56) References Cited

U.S. PATENT DOCUMENTS

| | | | | |
|---|---|---|---|---|
| 9,181,349 | B2 | 11/2015 | Baurin | |
| 9,221,917 | B2 | 12/2015 | Baurin | |
| 10,626,169 | B2 | 4/2020 | Beil et al. | |
| 10,882,922 | B2 * | 1/2021 | Yang | C07K 16/468 |
| 11,129,905 | B2 | 9/2021 | Yang et al. | |
| 11,186,649 | B2 * | 11/2021 | Wu | A61P 35/00 |
| 11,192,960 | B2 | 12/2021 | Yang et al. | |
| 2010/0226923 | A1 | 9/2010 | Rao | |
| 2012/0076782 | A1 | 3/2012 | Tesar | |
| 2012/0201827 | A1 | 8/2012 | Elias | |
| 2012/0251541 | A1 | 10/2012 | Baurin | |
| 2013/0345404 | A1 | 12/2013 | Baurin | |
| 2014/0213772 | A1 | 7/2014 | Ghayur | |
| 2014/0322217 | A1 | 10/2014 | Moore | |

(Continued)

FOREIGN PATENT DOCUMENTS

| | | | |
|---|---|---|---|
| CN | 101684158 | A | 3/2010 |
| CN | 103562221 | A | 2/2014 |

(Continued)

OTHER PUBLICATIONS

Alegre, M. et al. (Jun. 1994). "A Non-Activating "Humanized" Anti-CD3 Monoclonal Antibody Retains Immunosuppressive Properties In Vivo," Transplantation, 57(11):1537-1543.

Almeida, J. et al. (1999). "High-Sensitive Immunophenotyping and DNA Ploidy Studies for the Investigation of Minimal Residual Disease in Multiple Myeloma," British J of Haematol, 107:121-131.

Altschul, S.F.et al. (Sep. 1, 1997). "Gapped BLAST and PSI-BLAST: A New Generation of Protein Database Search Programs," Nucleic Acids Res. 25(17):3389-3402.

Atwell, S. et al. (1997). "Stable Heterodimers From Remodeling the Domain Interface of a Homodimer Using a Phage Display Library," J. Mol. Biol. 270 (1):26-35.

(Continued)

*Primary Examiner* — Laura B Goddard

(74) *Attorney, Agent, or Firm* — Morrison & Foerster LLP

(57) ABSTRACT

Provided herein are trispecific and/or trivalent binding proteins comprising four polypeptide chains that form three antigen binding sites that specifically bind one or more target proteins, wherein a first pair of polypeptides forming the binding protein possess dual variable domains having a cross-over orientation, and wherein and a second pair of polypeptides possess a single variable domain forming a single antigen binding site. In some embodiments, the binding proteins comprise a binding site that binds a CD28 polypeptide, a binding site that binds a CD3 polypeptide, and a binding site that binds a third polypeptide, such as a tumor target protein. In some embodiments, the binding proteins comprise four polypeptide chains that form three antigen binding sites that specifically bind one or more HIV target proteins. The disclosure also relates to methods for making trispecific and/or trivalent binding proteins and uses of such binding proteins.

29 Claims, 52 Drawing Sheets

Specification includes a Sequence Listing.

(56) References Cited

U.S. PATENT DOCUMENTS

2016/0200811 A1 7/2016 Baurin
2017/0320967 A1 11/2017 Yang
2018/0237511 A1 8/2018 Beil
2019/0054182 A1 2/2019 Yang
2019/0106504 A1 4/2019 Wu
2020/0054765 A1 2/2020 Yang
2020/0140552 A1 5/2020 Wu
2020/0255540 A1* 8/2020 Beil .................... C07K 16/244
2020/0317761 A1 10/2020 Beil et al.
2020/0385470 A1 12/2020 Bacac et al.
2020/0399369 A1 12/2020 Asokan
2021/0061925 A1 3/2021 Yang et al.
2022/0041746 A1 2/2022 Cameron et al.
2022/0119553 A1 4/2022 Yang et al.
2022/0226495 A1 7/2022 Yang et al.

FOREIGN PATENT DOCUMENTS

CN 104968685 A 10/2015
CN 105837688 A 8/2016
CN 109311966 A 2/2019
EP 0308936 A2 3/1989
EP 1378520 A1 1/2004
EP 1736484 A1 12/2006
EP 2014680 A1 1/2009
JP 2014519322 A 8/2014
JP 2015535828 A 12/2015
TW 201437227 A 10/2014
WO 199627011 A1 9/1996
WO 199951642 A1 10/1999
WO 2002056910 A1 7/2002
WO 2005000899 A2 1/2005
WO 2005000899 A3 8/2005
WO 2009149189 A2 12/2009
WO 2009149189 A3 3/2010
WO 2011038290 A2 3/2011
WO 2011154453 A1 12/2011
WO 2012065055 A3 7/2012
WO 2012092612 A1 7/2012
WO 2012135345 A1 10/2012
WO 2012154312 A1 11/2012
WO 2012158818 A2 11/2012
WO 2012158948 A1 11/2012
WO 2013070776 A1 5/2013
WO 2013086533 A1 6/2013
WO 2013163427 A1 10/2013
WO 2014047231 A1 3/2014
WO 2014089152 A1 6/2014
WO 2014093894 A2 6/2014
WO 2014093894 A3 7/2014
WO 2014116846 A2 7/2014
WO 2014144299 A2 9/2014
WO 2014144722 A2 9/2014
WO 2014116846 A3 10/2014
WO 2014144299 A3 12/2014
WO 2015017755 A1 2/2015
WO 2015063339 A1 5/2015
WO 2015149077 A1 10/2015
WO 2016033690 A1 3/2016
WO 2016116626 A1 7/2016
WO 2016187580 A1 11/2016
WO 2016196740 A1 12/2016
WO 2016205531 A2 12/2016
WO 2017053556 A1 3/2017
WO 2017074878 A1 5/2017
WO 2017106346 A2 6/2017
WO 2017180913 A2 10/2017
WO 2017180913 A3 2/2018
WO 2018120842 A1 7/2018
WO 2018151841 A1 8/2018
WO 2018183294 A1 10/2018
WO 2019074973 A2 4/2019
WO 2020076853 A1 4/2020

OTHER PUBLICATIONS

Brandsma, A.M. et al. (Oct. 1, 2017; e-pub. Aug. 16, 2017). "Single Nucleotide Polymorphisms of the High Affinity IgG Receptor FcγRI Reduce Immune Complex Binding and Downstream Effector Functions," The Journal of Immunology 199(7):2432-2439.

Chai, J.G. et al. (1997). "Immobilized Anti-CD3 mAb Induces Anergy in Murine Naive and Memory CD4+ T Cells," Int Immunol. 9(7):935-944.

Chen, H.W. et al. (Apr. 1, 2006, e-pub. Jan. 9, 2016). "Ex Vivo Expansion of Dendritic-Cell-Activated Antigenspecific CD41\+ T Cells With Anti-CD3/CD28, Interleukin-? and Interleukin-15: Potential for Adoptive T Cell Immunotherapy," Clinical Immunology 119(1):21-31.

Chothia, C. et al. (Aug. 20, 1987). "Canonical Structures for the Hypervariable Regions of Immunoglobulins," J. Mol. Biol. 196(4):901-917.

Chothia, C. et al. (Dec. 21-28, 1989). "Conformations of Immunoglobulin Hypervariable Regions," Nature 342 (6252):877-883.

Chu, S.Y et al. (Dec. 4, 2014). "Immunotherapy with Long-Lived Anti-CD38 x Anti-CD3 Bispecific Antibodies Stimulates Potent T Cell-Mediated Killing of Human Myeloma Cell Lines and CD38+ Cells in Monkeys: A Potential Therapy for Multiple Myeloma," Blood 124(21): 4727, 6 pages.

Colombian Opposition mailed on Mar. 15, 2019 for CO Application No. NC2018/0012107 filed on Nov. 9, 2018, twenty-one pages.

Deckert, J. et al. (2014; e-pub. Jul. 1, 2014). "SAR650984, a Novel Humanized CD38-Targeting Antibody, Demonstrates Potent Anti-Tumor Activity in Models of Multiple Myeloma and Other CD38+ Hematologic Malignancies," Clin. Cancer Res 20:4574-4583.

DiGiammarino, E. et al. (Sep.-Oct. 2011, e-pub. Sep. 1, 2011). "Ligand Association Rates to the Inner-Variable-Domain of a Dual-Variable-Domain Immunoglobulin are Significantly Impacted by Linker Design," MAbs. 3(5):487-494.

EBI Accession No. GSP: BAH64671 Sequence (Jan. 13, 2013). "Anti-HIV Human Antibody Variable Light Chain (VL), VRCO1," one page.

EBI Accession No. GSP: BAO38135 Sequence (Jul. 4, 2013). "Human Germline 10E8 Antibody Heavy Chain Revertant Seq ID N0:149," one page.

Esensten, J.H. et al. (May 17, 2016). "CD28 Costimulation: From Mechanism to Therapy," Immunity 44:973-988.

Findlay, L. et al. (2010; e-pub. Nov. 4, 2009). "Improved In Vitro Methods to Predict the In Vivo Toxicity in Man of Therapeutic Monoclonal Antibodies Including TGN1412," J Immunol Methods 352:1-12.

Fournier, P. et al. (Jan. 2010). "Tumor Antigen-Dependent and Tumor Antigen-Independent Activation of Antitumor Activity in T Cells by a Bispecific Antibody-Modified Tumor Vaccine," Clinical & Developmental Immunology 2010(1):Article IDS 423781, 12 pages.

Garfall, A.L. et al. (Nov. 21, 2019). "Three is a Charm for anAntibody to Fight Cancer," Nature 575:450-451.

Gratama, J,W. et al. (Sep. 1, 2001). "Tetramer-Based Quantification of Cytomegalovirus (CMV)-Specific CD81 T Lymphocytes in T-Cell-Depleted Stem Cell Grafts and After Transplantation May Identify Patients at Risk for Progressive CMV Infection," Blood 98(5):1358-1364.

Haas, C. et al. (Mar. 31, 2005; e-pub. Nov. 25, 2004). "T-cell Triggering by CD3- and CD28-Binding Molecules Linked to a Human Virus-Modified Tumor Cell Vaccine," Vaccine 23(19):2439-2453.

Hartman, W.R. et al. (May 17, 2010). "CD38 Expression, Function, and Gene Resequencing in a Human Lymphoblastoid Cell Line-Based Model System," Leukemia and Lymphoma 51(7):1315-1325.

Hinton, P.R. et al. (Jan. 1, 2006). "An Engineered Human IgG1 Antibody With Longer Serum Half-Life," J. Immunol. 176(1):346-356.

Hitoshi, N. et al. (Dec. 15, 1991). "Efficient Selection for High-Expression Transfectants with a Novel Eukaryotic Vector," Gene 108(2):193-200.

(56) References Cited

OTHER PUBLICATIONS

Hui, E. et al. (Mar. 31, 2017). "T Cell Costimulatory Receptor CD28 is a Primary Target for PD-1-Mediated Inhibition," Science 355(6332):1428-1433, 13 pages.
International Preliminary Report on Patentability dated Sep. 28, 2021, dated Aug. 6, 2020, for PCT Patent Application No. PCT/US2020/027320, filed Apr. 8, 2020, 10 pages.
International Preliminary Report on Patentability dated May 11, 2018 for PCT Application No. PCT/US2016/058540 filed on Oct. 24, 2016, seven pages.
International Preliminary Report on Patentability dated Oct. 25, 2018 for PCT Application No. PCT/US2017/027488, filed on Apr. 13, 2017, thirty one pages.
International Search Report and Written Opinion dated Jan. 2, 2018 for PCT Application No. PCT/US2017/027488, filed on Apr. 13, 2017, forty four pages.
International Search Report and Written Opinion of the International Searching Authority dated Apr. 8, 2020, for International Patent Application No. PCT/US2020/027320, filed Apr. 8, 2020, 18 pages.
International Search Report and Written Opinion of the International Searching Authority dated Mar. 10, 2017 for PCT Application No. PCT/US2016/058540 filed on Oct. 24, 2016, fifteen pages.
International Search Report dated Dec. 17, 2019, for PCT Application No. PCT/US2019/055232, filed on Oct. 8, 2019, seven pages.
International Search Report dated May 17, 2019, for PCT Application No. PCT/US2018/055084, filed on Oct. 9, 2018, twelve pages.
Invitation to Pay Additional Fees and, Where Applicable, Protest Fee dated Feb. 20, 2019, for PCT Application No. PCT/US2018/055084, filed on Oct. 9, 2018, twenty three pages.
Invitation to Pay Additional Fees and, Where Applicable, Protest Fee dated Oct. 16, 2017, for PCT Application No. PCT/US2017/027488, filed on Apr. 13, 2017, twenty eight pages.
Jakob, C.G. et al. (May 1, 2013, e-pub. Apr. 2, 2013). "Structure Reveals Function of the Dual Variable Domain Immunoglobulin (DVD-Ig™) Molecule," MAbs. 5(3):358-363.
Kalim, M. et al. (2017; e-pub. Aug. 2, 2017). "Intracellular Trafficking of New Anticancer Therapeutics: Antibody—Drug Conjugates," Drug Des. Devel. Ther. 11:2265-2276.
Kilpatrick, K.E. et al. (Aug. 1997). "Rapid Development of Affinity Matured Monoclonal Antibodies Using RIMMS," Hybridoma l6(4):381-389.
Lefranc, M.P. et al. (Jan. 2003). "IMGT Unique Numbering for Immunoglobulin and T Cell Receptor Variable Domains and Ig Superfamily V-Like Domains," Dev. Comp. Immunol. 27(1):55-77.
Li, T. et al. (Jun. 2, 2016). "Immuno-Targeting the Multifunctional CD38 Using Nanobody," Scientific Reports 6(1):27055, 11 pages.
Liu, Q. et al. (Feb. 13, 2019). "Improvement of Antibody Functionality by Structure-Guided Paratope Engraftment," Nature Communications 10:721, 13 pages.
Liu, Q. et al. (Sep. 2005). "Crystal Structure of Human CD38 Extracellular Domain," Structure 13(9):1331-1339.
Maccallum, R.M. et al. (1996). "Antibody-Antigen Interactions: Contact Analysis and Binding Site Topography," J. Mol. Biol. 262:732-745.
Martin, A.C.R. (2010). "Protein Sequence and Structure Analysis of Antibody Variable Domains," Chapter 3 in Antibody Engineering, vol. 2. Kontermann R., Dübei S., eds. Springer-Verlag, Berlin, pp. 33-51.
Mateo, G. et al. (May 15, 2005). "Genetic Abnormalities and Patterns of Antigenic Expression in Multiple Myeloma," Clin. Cancer Res. 11(10):3661-3667.
McDermott, S.P. et al. (Jul. 15, 2010, e-published as Apr. 19, 2010). "Comparison of Human Cord Blood Engraftment Between Immunocompromised Mouse Strains," Blood 116(2):193-200.
McKeage, K. (Feb. 2016). "Daratumumab: First Global Approval," Drugs, 76(2):275-281.
Merchant, A. M. et al. (Jul. 1998). "An Efficient Route To Human Bispecific IgG," Nature Biotechnology 16:677-681.
Moore, G. et al. (Dec. 5, 2015). "1798 Tuning T Cell Affinity Improves Efficacy and Safety of Anti-CD38 x Anti-CD3 Bispecific Antibodies in Monkeys—a Potential Therapy for Multiple Myeloma," American Society of Hematology, Poster Abstract presented at 57th Annual Meeting & Exposition, Orlando, FL, three pages.
Morphosys. (Nov. 25, 2010). "R&D Day 2010," 102 pages, (as cited in 299.41)—Rojkjaer, L. (Nov. 29, 2010). "Morphosys R&D 2010," URL:https://www.morphosys.de/sites/default/files/phoneconferences/downloads/10125mar_rd_nov_2010_ nyc_ final.pdf.
Nair, J.R. et al. (2011; e-pub. Jun. 29, 2011). "CD28 Expressed on Malignant Plasma Cells Induces a Prosurvival and Immunosuppressive Microenvironment," J Immunol. 187:1243-1253.
Padlan, E.A. et al. (Jun. 2017). "Identification of Specificity-Determining Residues in Antibodies," FASEB J. 9(1):133-139.
Parslow, A.C. et al. (2016). "Antibody-Drug Conjugates for Cancer Therapy," Biomedicines 4:14, pp. 1-17.
Penaranda, C.I. et al. (Aug. 15, 2011). "Anti-CD3 Therapy Promotes Tolerance by Selectively Depleting Pathogenic Cells While Preserving Regulatory T Cells," J Immunol. 187(4):2015-2022, 19 pages.
Peters, B. et al. (Mar. 2005; e-pub. Mar. 15, 2005). "The Immune Epitope Database and Analysis Resource: From Vision to Blueprint," PLos Biol. 3(3):e91, pp. 0379-0381.
Ridgway, J.B.B. et al. (1996). "Knobs-Into-Holes' Engineering of Antibody CH3 Domains for Heavy Chain Heterodimerization," Protein Engineering 9(7):617-621.
Robillard, N. et al. (Jun. 1998). "CD28, a Marker Associated with Tumoral Expansion in Multiple Myeloma," Clin Cancer Res. 4:1521-1526.
Rudikoff, S. et al. (Mar. 1982). "Single Amino Acid Substitution Altering Antigen-Binding Specificity," Proc. Natl. Acad. Sci. USA 79:1979-1983.
Sarzotti-Kelsoe, M. et al. (Jul. 2014; e-published on Dec. 1, 2013). "Optimization and Validation of the TZM-BI Assay for Standardized Assessments of Neutralizing Antibodies Against HIV-1," Immunological Methods 409:131-146, 37 pages.
Sharma, P. et al. (Apr. 3, 2015). "The Future of Immune Checkpoint Therapy," Science 348(6230):56-61.
Shields, R.L. et al. (Mar. 2, 2001). "High Resolution Mapping of the Binding Site on Human IgG1 for FcγRI, FcγRII. FcγRIII, and FcRn and Design of IgG1 Variants With Improved Binding to the FcγR," J. Biol.Chem. 276(9):6591-6604.
Shultz, L.D. et al. (Jul. 2014). "Human Cancer Growth and Therapy in NOD/SCID/IL2Rγnull (NSG) Mice," Cold Spring Harb. Protoc. 2014(7):694-708, 24 pages.
Smith, E.J. et al. (Dec. 11, 2015). "A Novel, Native-Format Bispecific Antibody Triggering T-cell Killing of B-cells is Robustly Active in Mouse Tumor Models and Cynomolgus Monkeys," Sci Rep 5(17943):1-12.
Song, Li-Ping et al. (Jun. 1, 2003). "A New Model of Trispecific Antibody with Cytotoxicity Against Tumor Cells," Acta Biochimica Etbiophysica Sinica 35(6):503-510.
Spiess, C. et al. (2015, e-pub. Jan. 27, 2015). "Alternative Molecular Formats and Therapeutic Applications for Bispecific Antibodies," Mol. Immunol. 67:95-106.
Spiess, C. et al. (Sep. 13, 2013). "Development of a Human IgG4 Bispecific Antibody for Dual Targeting of Interleukin-4 (IL-4) and Interleukin-13 (IL-13) Cytokines," The Journal of Biological Chemistry 288(37):26583-26593.
Stebbings, R. et al. (Sep. 1, 2007). ""Cytokine Storm" in the Phase I Trial of Monoclonal Antibody TGN1412 Better Understanding the Causes to Improve Preclinical Testing of Immunotherapeutics," J. Immunol. 179(5):3325-3331.
Steinmetz, A. et al. (Mar. 16, 2016). "CODV-Ig, a Universal Bispecific Tetravalent and Multifunctional Immunoglobulin Format for Medical Applications," MABS 8(5):867-878, with Supplementary material, 59 pages.
Stevenson, G.T. (Nov.-Dec. 2006), "CD38 as a Therapeutic Target," Mol. Med. 12(11-12):345-346.
Suntharalingam, G. et al. (Sep. 7, 2006). "Cytokine Storm in a Phase 1 Trial of the Anti-CD28 Monoclonal Antibody TGN1412," N Engl J Med 355(10):1018-1028.

(56) References Cited

OTHER PUBLICATIONS

Tabares, P. et al. (Apr. 2014; e-pub. Feb. 1, 2014). "Human Regulatory T Cells are Selectively Activated by Low-Dose Application of the CD28 Superagonist TGN1412/TAB08," Eur J Immunol. 44:1225-1236.
Tiller, T. et al. (Oct. 2009). "Cloning and Expression of Murine Ig Genes From Single B Cells," J. Immunol. Methods 350(1-2):183-193.
U.S. Appl. No. 16/596,474, filed Apr. 8, 2020, for Mangaiarkarasi et al. (Copy not submitted herewith pursuant to the waiver of 37 C.F.R. 1,98(a)(2)(iii) issued by the Office dated Sep. 21, 2004).
U.S. Appl. No. 16/843,792, filed Apr. 8, 2020, for Mangaiarkarasi et al. (Copy not submitted herewith pursuant to the waiver of 37 C.F.R. 1,98(a)(2)(iii) issued by the Office dated Sep. 21, 2004).
U.S. Appl. No. 17/099,439, filed Nov. 16, 2020, for Yang et al. (Copy not submitted herewith pursuant to the waiver of 37 C.F.R. 1.98(a)(2)(iii) issued by the Office dated Sep. 21, 2004).
U.S. Appl. No. 17/404,908, filed Aug. 17, 2021, for Yang et al. (Copy not submitted herewith pursuant to the waiver of 37 C.F.R. 1.98(a)(2)(iii) issued by the Office dated Sep. 21, 2004).
U.S. Appl. No. 17/503,038, filed Oct. 15, 2021, for Cameron et al. (Copy not submitted herewith pursuant to the waiver of 37 C.F.R. 1.98(a)(2)(iii) issued by the Office dated Sep. 21, 2004).
U.S. Appl. No. 17/515,227, filed Oct. 29, 2021, for Yang et al. (Copy not submitted herewith pursuant to the waiver of 37 C.F.R. 1.98(a)(2)(iii) issued by the Office dated Sep. 21, 2004).
U.S. Appl. No. 17/737,814, filed May 5, 2022, for Dabdoubi et al. (Copy not submitted herewith pursuant to the waiver of 37 C.F.R. 1.98(a)(2)(iii) issued by the Office dated Sep. 21, 2004).
Waibler, Z. et al. (Mar. 5, 2008). "Signaling Signatures and Functional Properties of Anti-Human CD28 Superagonistic Antibodies," PLoS One 3(3):e1708, pp. 1-13.
Wang, X. (Apr. 1, 2004). "A New Recombinant Single Chain Trispecific Antibody Recruits T Lymphocytes to Kill CEA (Carcinoma Embryonic Antigen) Positive Tumor Cells In Vitro Efficiently," Journal of Biochemistry 135(4):555-565.
Wang, X. et al. (Jan. 2018; e-pub. Oct. 6, 2017). "IgG Fc Engineering to Modulate Antibody Effector Functions," Protein & Cell 9(1):63-73.
Wennerberg, A.E. et al. (Oct. 1993), "Hepatocyte Paraffin 1: A Monoclonal Antibody that Reacts with Hepatocytes and can be Used for Differential Diagnosis of Hepatic Tumors," Am J Pathol. 143(4):1050-1054.
Willems, A. et al. (Nov. 1, 2005; e-pub. May 13, 2005). "CD3×CD28 Cross-Interacting Bispecific Antibodies Improve Tumor Cell Dependent T-Cell Activation," Cancer Immunology, Immunotherapy 54(11):1059-1071.
Written Opinion of the International Searching Authority dated Dec. 17, 2019, for PCT Application No. PCT/US2019/055232, filed on Oct. 8, 2019, six pages.
Wu, L. et al. (Nov. 18, 2019). "Trispecific Antibodies Enhance the Therapeutic Efficacy of Tumor-Directed T Cells Through T Cell Receptor Co-Stimulation," Nat Cancer 1:86-98.
Xu, L. et al. (Oct. 6, 2017; e-pub. Sep. 20, 2017). "Trispecific Broadly Neutralizing HIV Antibodies Mediate Potent SHIV Protection in Macaques," Science 358(6359):85-90, 17 pages.
Masui, S. et al. (Mar. 1, 2005). "An Efficient System to Establish Multiple Embryonic Stem Cell Lines Carrying an Inducible Expression Unit," Nucleic Acids Res. 33(4):e43, pp. 1-8.

* cited by examiner

Re-direct T cell to kill tumor cells:

1. *HER2-TCE engages HER2+ tumor and T cells*
2. *T cells signal through CD3/CD28, initiating anti-tumor activities*
3. *HER2+ tumor cells are killed by T cells*

Addition of anti-CD28 provides an advantageous co-stimulatory signal:

- *Enhance duration and magnitude of the response*
- *Promote T cell differentiation & survival*

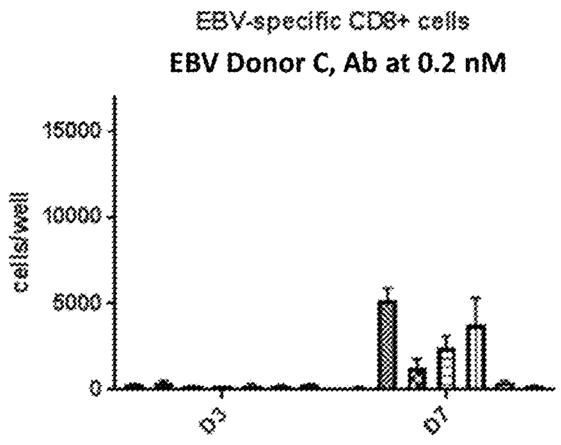
FIG. 8A
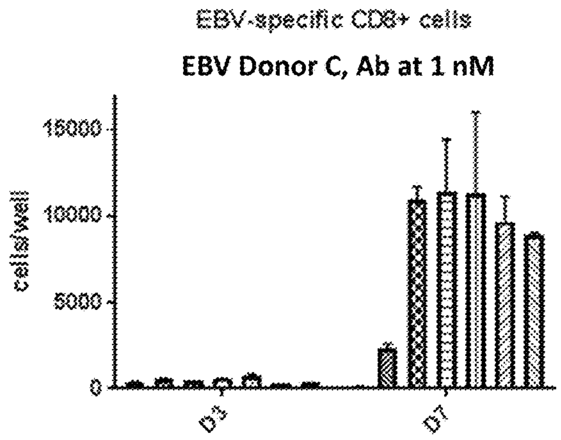
FIG. 8B

Results of Efficacy study of ZR-75- 1 Her2-CD28-CD3 dose titration

HCC1954

| HER2 Density (per cell) | IHC | HercepTest |
| --- | --- | --- |
| 149,601 / 33,301 | 3+ | 3+ |

BT20

| HER2 Density (per cell) | IHC | HercepTest |
|---|---|---|
| 60,829 | 1+ | 1+ |

| HER2 Density (per cell) | IHC | HercepTest |
|---|---|---|
| 9,094 | 0+ | 0 |

| | #1 | #2 | #3 | #4 | #5 | #6 | Control |
|---|---|---|---|---|---|---|---|
| HCC1954 (HER2-hi) | 134.3 | 52.0 | 91.6 | 93.7 | 84.5 | 138.0 | 208.4 |
| BT20 (HER2-mid) | 427.6 | 393.9 | 413.6 | 491.4 | 1023.0 | 350.2 | 605.1 |
| MDA-MB231 (HER2-lo) | 761.2 | 471.1 | 665.4 | 1109.3 | 636.3 | 645.1 | 2368.7 |

FIG. 18A

| | #1 | #2 | #3 | #4 | #5 | #6 | Control |
|---|---|---|---|---|---|---|---|
| OE.19 (HER2-hi) | 34.3 | 46.5 | 62.8 | 93.2 | 180.6 | 424.4 | 50.4 |
| GSU (HER2-mid) | 140.4 | 64.2 | 77.6 | 87.3 | 133.0 | 215.2 | 181.9 |

FIG. 18B

TRISPECIFIC BINDING PROTEINS, METHODS, AND USES THEREOF

CROSS REFERENCE TO RELATED APPLICATIONS

This application claims priority to U.S. Provisional Application No. 62/831,572, filed Apr. 9, 2019; U.S. Provisional Application No. 62/831,415, filed Apr. 9, 2019; EP Application No. EP19306312.0, filed Oct. 8, 2019; and EP Application No. 19306261.9, filed Oct. 2, 2019, the disclosures of each of which are incorporated herein by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 183952032000SEQLIST.TXT, date recorded: Apr. 8, 2020, size: 1,107 KB).

FIELD

The disclosure relates to trispecific and/or trivalent binding proteins comprising four polypeptide chains that form three antigen binding sites that specifically bind one or more target proteins, wherein a first pair of polypeptides forming the binding protein possess dual variable domains having a cross-over orientation. The disclosure also relates to methods for making trispecific and/or trivalent binding proteins and uses of such binding proteins.

BACKGROUND

Monoclonal antibody based biotherapeutics have become an important avenue for new drug development. Monoclonal antibody technology offers specific targeting, precise signaling delivery and/or payload to specific cell population, and provides long lasting biological effect through its Fc functions. Efforts in antibody engineering have allowed developing bispecific antibodies combining the specificities of two monoclonal antibodies for various biological applications, expanding the scope of antibody drug development. Newly discovered neutralizing antibodies with improved breadth and potency may provide more options for developing biotherapeutics to treat complexed diseases such as cancer, arthritis, and/or inflammatory disorders.

Immuno-oncology is a promising, emerging therapeutic approach to disease management in cancer. The immune system is the first line of defense against cancer development and progression. There is now large evidence that T cells are able to control tumor growth and prolong the survival of cancer patients in both early and late stages of disease. However, T cells specific for tumors can be limited in a number of ways preventing them from controlling the disease.

As part of the human adaptive immunity, T cell immunity plays crucial role in controlling viral infection and cancer, possibly eliminating infected cells and malignant cells which result in clearance of viral infection or cure of cancer. In chronic infectious diseases such as Herpes viral infection (HSV, CMV, EBV, etc.), HIV, and HBV, viruses establish their persistence in humans by various mechanisms including immune suppression, T cell exhaustion, and latency establishment. Nevertheless, viral infection generally induces viral antigen specific immunity including antigen specific CD8 T cells that can readily recognize infected cells for controlling or killing through cytokine release or cytotoxic T cell (CTL) mediated killing processes.

Thus, viral antigen specific T cell activation and/or amplification in vivo and/or ex vivo may provide therapeutic strategies against chronic viral infections.

Anti-retroviral therapy (ART) has been the standard of care for HIV/AIDS patients in the past decades. ART drugs target internal proteins such as reverse transcriptase (RT), integrase (IN), and viral protease (PI) by inhibiting reverse transcription of HIV-1 genome, integration of HIV-1 genome, and proteolytic cleavage of protein precursors that are necessary for the production of infectious viral particles. Treatment using ART or combination of different classes of ART results in inhibition of HIV-1 replication and subsequent reduction of viremia, often to undetectable level (aviremic status). Although ART greatly helps HIV patients in controlling their disease progression, and containing the global HIV epidemic, it does require patients taking daily medicines often following a strict regimen. About 10% patients fail therapy each year due to drug toxicity, suboptimal adherence and emerging drug resistance. As more HIV patients can live a normal life span (over 80 years), chronic complications are of particular concern, such as aging and drug-drug interaction, and cardiovascular/renal/bone toxicities. The economic burden treating HIV/AIDS has not subsided thus far.

HIV latently infects long-lived resting memory CD4+ T cells and others as a form of proviral DNA integrated into the host genome. The latently infected cells survive for decades and self-renew like stem cells via homeostatic proliferation, which is regarded as an HIV-1 reservoir. The HIV-1 reservoirs are neither affected by ART nor the host immune system as they do not express viral proteins. Yet, a small proportion of cells among the reservoirs are randomly reactivated by unknown mechanism(s), which are responsible for recurrence of viremia once ART is stopped.

Therefore, a need exists for developing HIV/AIDS treatments to target the HIV-1 reservoir(s), and ultimately eliminate them completely, achieving a cure, or long term remission of HIV without any further treatment. Any therapeutic strategy to eliminate the HIV-1 reservoir needs to activate the reservoir first, followed by elimination of the activated HIV-1 reservoir cells.

All references cited herein, including patent applications, patent publications, and UniProtKB/Swiss-Prot Accession numbers are herein incorporated by reference in their entirety, as if each individual reference were specifically and individually indicated to be incorporated by reference.

BRIEF SUMMARY

To meet these and other needs, provided herein are trispecific binding proteins (e.g., antibodies) that form three antigen binding sites. These binding proteins can specifically bind one, two, or three antigen targets or target proteins, such as CD28, CD3, and a tumor target protein. Some tumors express specific antigens. For example, HER2 amplification and overexpression can be found in molecular subtypes of breast cancer, and also in gastric, ovarian, lung and prostate carcinomas. Optimal activation of T cells requires two factors: 1. Antigen recognition and 2. Co-stimulation. Using the trispecific HER2/CD28×CD3 trispecific binding proteins described herein, Signal 1 is provided by an agonist anti-CD3 binding site, and Signal 2 is provided by an agonist anti-CD28 binding site. The trispecific binding protein recruits T cells to the tumor via HER2, CD38, or a binding site recognizing another tumor target protein and activates the engaged T cells via anti-CD3 and -CD28. The resulting activation induces the killing potential of the immune cells against the nearby tumor cells. In addition, anti-CD3 binding sites are described with high affinity binding to human CD3 polypeptides and potential manufacturing liabilities (e.g., deamidation sites) removed.

Further provided herein are anti-CD38/CD28×CD3 trispecific antibodies that were developed and evaluated for their potential in activating T cells, and subsequent proliferation and/or amplification of antigen specific T cells. These trispecific Abs can effectively expand CD4 and CD8 effector and memory populations, including antigen specific CD8 T central memory and effector memory cells in vitro. Specifically, in vitro expansion of CMV, EBV, HIV-1, Influenza specific CD8 central memory and effector memory cells were demonstrated. The anti-CD38/CD28×CD3 trispecific antibodies described herein exhibited novel properties by engaging CD3/CD28/CD38, providing signaling pathways to stimulate and expand T cells, which may offer an effective strategy treating chronic infectious diseases such as HSV, CMV, EBV, HIV-1, and HBV infections.

To meet these and other needs, provided herein are binding proteins that bind CD38 polypeptides (e.g., human and cynomolgus monkey CD38 polypeptides), including monospecific, bispecific, or trispecific binding proteins with at least one antigen binding site that binds a CD38 polypeptide. Advantageously, these binding proteins have the ability to recruit T cells to the proximity of cancer cells, subsequently to activate T cells and promote the activated T cells killing of adjacent cancer cells through a Granzyme/Perforin mechanism, providing a different mode of action for anti-tumor activity from anti-CD38 antibodies such as DARZALEX® (daratumumab). Moreover, the ability to bind both human and cynomolgus monkey CD38 polypeptides allows binding proteins to be readily tested in preclinical toxicological studies, e.g., to evaluate their safety profiles for later clinical use.

In some embodiments, provided herein are binding proteins comprising four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and $V_{L1}$ form a first antigen binding site;

wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of $QSLVHX_1NX_2X_3TY$, wherein $X_1$ is E or Q, $X_2$ is A or L, and $X_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65); and wherein $V_{H3}$ and $V_{L3}$ form a third antigen binding site.

In some embodiments, the first binding site binds a CD28 polypeptide. In some embodiments, the $V_{H1}$ domain comprises a CDR-H1 sequence comprising the amino acid sequence of GYTFTSYY (SEQ ID NO:49), a CDR-H2 sequence comprising the amino acid sequence of IYPGNVNT (SEQ ID NO:50), and a CDR-H3 sequence comprising the amino acid sequence of TRSHYGLDWNFDV (SEQ ID NO:51), and the $V_{L1}$ domain comprises a CDR-L1 sequence comprising the amino acid sequence of QNIYVW (SEQ ID NO:52), a CDR-L2 sequence comprising the amino acid sequence of KAS (SEQ ID NO:53), and a CDR-L3 sequence comprising the amino acid sequence of QQGQTYPY (SEQ ID NO:54). In some embodiments, the $V_{H1}$ domain comprises the amino acid sequence of QVQLVQSGAEVVKPGASVKVSCKASGYTFTSYYIHWVRQAPGQGLEWIGSIYPGN VNTNYAQKFQGRATLTVDTSISTAYMELSRLRSDDTAVYYCTRSHYGLDWNFDV WGKGTTVTVSS (SEQ ID NO:91), and/or the $V_{L1}$ domain comprises the amino acid sequence of DIQMTQSPSSLSASVGDRVTITCQASQNIYVWLNWYQQKPGKAPKLLIYKASNLHT GVPSRFSGSGSGTDFTLTISSLQPEDIATYYCQQGQTYPYTFGQGTKLEIK (SEQ ID NO:92).

In some embodiments, the CDR-L1 sequence of the $V_{L2}$ domain comprises an amino acid sequence selected from the group consisting of QSLVHQNAQTY (SEQ ID NO:59), QSLVHENLQTY (SEQ ID NO:60), QSLVHENLFTY (SEQ ID NO:61), and QSLVHENLRTY (SEQ ID NO:62). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHQNAQTY (SEQ ID NO:59), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHENLQTY (SEQ ID NO:60), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHENLFTY (SEQ ID NO:61), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHENLRTY (SEQ ID NO:62), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, the $V_{H2}$ domain comprises the amino acid sequence of QVQLVESGGGVVQPGRSLRLS-CAASGFTFTKAWMHWVRQAPGKQLEWVAQIKD KSNSYATYYADSVKGRFTISRDDSKNTLYLQMNSL-RAEDTAVYYCRGVYYALSPF DYWGQGTLVTVSS (SEQ ID NO:93), and/or the $V_{L2}$ domain comprises an amino acid sequence selected from the group consisting of DIVMTQTPLSLSVTPGQPASISCKSSQSLVHQNAQ-TYLSWYLQKPGQSPQSLIYKVS NRFSGVPDRFSGSGSGTDFTLKISRVEAE-DVGVYYCGQGTQYPFTFGSGTKVEIK (SEQ ID NO:95), DIVMTQTPLSLSVTPGQPASISCK-SSQSLVHENLQTYLSWYLQKPGQSPQSLIYKVS NRFSGVPDRFSGSGSGTDFTLKISRVEAE-DVGVYYCGQGTQYPFTFGSGTKVEIK (SEQ ID NO:96), DIVMTQTPLSLSVTPGQPASISCK-SSQSLVHENLFTYLSWYLQKPGQSPQSLIYKVS NRFSGVPDRFSGSGSGTDFTLKISRVEAE-DVGVYYCGQGTQYPFTFGSGTKVEIK (SEQ ID NO:97), and DIVMTQTPLSLSVTPGQPASISCK-SSQSLVHENLRTYLSWYLQKPGQSPQSLIYKVS NRFSGVPDRFSGSGSGTDFTLKISRVEAE-DVGVYYCGQGTQYPFTFGSGTKVEIK (SEQ ID NO:98). In some embodiments, the $V_{H2}$ domain comprises the amino acid sequence of QVQLVES-GGGVVQPGRSLRLS-CAASGFTFTKAWMHWVRQAPGKQLEWVAQIKD KSNSYATYYADSVKGRFTISRDDSKNTLYLQMNSL-RAEDTAVYYCRGVYYALSPF DYWGQGTLVTVSS (SEQ ID NO:93) or QVQLVESGGGVVQPGRSLRLS-CAASGFTFTKAWMHWVRQAPGKQLEWVAQIKD KSNSYATYYASSVKGRFTISRDDSKNTLYLQMNSL-RAEDTAVYYCRGVYYALSPF DYWGQGTLVTVSS (SEQ ID NO:595), and/or the $V_{L2}$ domain comprises an amino acid sequence selected from the group consisting of DIVMTQTPLSLSVTPGQPASISCKSSQSLVHQNAQ-TYLSWYLQKPGQSPQSLIYKVS NRFSGVPDRFSGSGSGTDFTLKISRVEAE-DVGVYYCGQGTQYPFTFGSGTKVEIK (SEQ ID NO:95), DIVMTQTPLSLSVTPGQPASISCK-SSQSLVHENLQTYLSWYLQKPGQSPQSLIYKVS NRFSGVPDRFSGSGSGTDFTLKISRVEAE-DVGVYYCGQGTQYPFTFGSGTKVEIK (SEQ ID NO:96), DIVMTQTPLSLSVTPGQPASISCK-SSQSLVHENLFTYLSWYLQKPGQSPQSLIYKVS NRFSGVPDRFSGSGSGTDFTLKISRVEAE-DVGVYYCGQGTQYPFTFGSGTKVEIK (SEQ ID NO:97), and DIVMTQTPLSLSVTPGQPASISCK-SSQSLVHENLRTYLSWYLQKPGQSPQSLIYKVS NRFSGVPDRFSGSGSGTDFTLKISRVEAE-DVGVYYCGQGTQYPFTFGSGTKVEIK (SEQ ID NO:98). In some embodiments, a binding protein of the present disclosure comprises an antigen binding site comprising: an antibody heavy chain variable (VH) domain comprising the amino acid sequence of SEQ ID NO:93, and/or an antibody light chain variable (VL) domain comprising the amino acid sequence of SEQ ID NO:95. In some embodiments, a binding protein of the present disclosure comprises an antigen binding site comprising: an antibody heavy chain variable (VH) domain comprising the amino acid sequence of SEQ ID NO:595, and/or an antibody light chain variable (VL) domain comprising the amino acid sequence of SEQ ID NO:95. In some embodiments, a binding protein of the present disclosure comprises an antigen binding site comprising: an antibody heavy chain variable (VH) domain comprising the amino acid sequence of SEQ ID NO:93, and/or an antibody light chain variable (VL) domain comprising the amino acid sequence of SEQ ID NO:96. In some embodiments, a binding protein of the present disclosure comprises an antigen binding site comprising: an antibody heavy chain variable (VH) domain comprising the amino acid sequence of SEQ ID NO:93, and/or an antibody light chain variable (VL) domain comprising the amino acid sequence of SEQ ID NO:97. In some embodiments, a binding protein of the present disclosure comprises an antigen binding site comprising: an antibody heavy chain variable (VH) domain comprising the amino acid sequence of SEQ ID NO:93, and/or an antibody light chain variable (VL) domain comprising the amino acid sequence of SEQ ID NO:98.

In some embodiments, the third antigen binding site binds a tumor target protein. In some embodiments, the tumor target protein is a CD38 polypeptide (e.g., a human CD38 polypeptide). In some embodiments, the tumor target protein is a HER2 polypeptide (e.g., a human HER2 polypeptide). In some embodiments, a tumor target protein of the present disclosure includes, without limitation, A2AR, APRIL, ATPDase, BAFF, BAFFR, BCMA, BlyS, BTK, BTLA, B7DC, B7H1, B7H4 (also known as VTCN1), B7H5, B7H6, B7H7, B7RP1, B7-4, C3, C5, CCL2 (also known as MCP-1), CCL3 (also known as MIP-1a), CCL4 (also known as MIP-1b), CCL5 (also known as RANTES), CCL7 (also known as MCP-3), CCL8 (also known as mcp-2), CCL11 (also known as eotaxin), CCL15 (also known as MIP-1d), CCL17 (also known as TARC), CCL19 (also known as MIP-3b), CCL20 (also known as MIP-3a), CCL21 (also known as MIP-2), CCL24 (also known as MPIF-2/eotaxin-2), CCL25 (also known as TECK), CCL26 (also known as eotaxin-3), CCR3, CCR4, CD3, CD19, CD20, CD23 (also known as FCER2, a receptor for IgE), CD24, CD27, CD28, CD38, CD39, CD40, CD70, CD80 (also known as B7-1), CD86 (also known as B7-2), CD122, CD137 (also known as 41BB), CD137L, CD152 (also known as CTLA4), CD154 (also known as CD40L), CD160, CD272, CD273 (also known as PDL2), CD274 (also known as PDL1), CD275 (also known as B7H2), CD276 (also known as B7H3), CD278 (also known as ICOS), CD279 (also known as PD-1), CDH1 (also known as E-cadherin), chitinase, CLEC9, CLEC91, CRTH2, CSF-1 (also known as M-CSF), CSF-2 (also known as GM-CSF), CSF-3 (also known as GCSF), CX3CL1 (also known as SCYD1), CXCL12 (also known as SDF1), CXCL13, CXCR3, DNGR-1, ectonucleoside triphosphate diphosphohydrolase 1, EGFR, ENTPD1, FCER1A, FCER1, FLAP, FOLH1, Gi24, GITR, GITRL, GM-CSF, Her2, HHLA2, HMGB1, HVEM, ICOSLG, IDO, IFNα, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb (also known as a receptor for IL25), IL18, IL22, IL23, IL25, IL27, IL33, IL35, ITGB4 (also known as b4 integrin), ITK, KIR, LAG3, LAMP1, leptin, LPFS2, MHC class II, MUC-1, NCR3LG1, NKG2D, NTPDase-1, OX40, OX40L, PD-1H, platelet receptor, PROM1, S152, SISP1, SLC, SPG64, ST2 (also known as a receptor for IL33), STEAP2, Syk kinase, TACI, TDO, T14, TIGIT, TIM3, TLR, TLR2, TLR4, TLR5, TLR9, TMEF1, TNFα, TNFRSF7, Tp55, TREM1, TSLP (also known as a co-receptor for IL7Ra), TSLPR, TWEAK, VEGF, VISTA, Vstm3, WUCAM, and XCR1 (also known as GPR5/CCXCR). In some embodiments, one or more of the above antigen targets are human antigen targets.

In some embodiments, the third antigen binding site binds a human CD38 polypeptide. In some embodiments, the $V_{H3}$ domain comprises a CDR-H1 sequence comprising the amino acid sequence of GYTFTSYA (SEQ ID NO:13), a CDR-H2 sequence comprising the amino acid sequence of IYPGQGGT (SEQ ID NO:14), and a CDR-H3 sequence comprising the amino acid sequence of ARTGGLRRAYFTY (SEQ ID NO:15), and the $V_{L3}$ domain comprises a CDR-L1 sequence comprising the amino acid sequence of QSVSSYGQGF (SEQ ID NO:16), a CDR-L2 sequence comprising the amino acid sequence of GAS (SEQ ID NO:17), and a CDR-L3 sequence comprising the amino acid sequence of QQNKEDPWT (SEQ ID NO:18). In some embodiments, the $V_{H3}$ domain comprises a CDR-H1 sequence comprising the amino acid sequence of GYTLTEFS (SEQ ID NO:19), a CDR-H2 sequence comprising the amino acid sequence of FDPEDGET (SEQ ID NO:20), and a CDR-H3 sequence comprising the amino acid sequence of TTGRFFDWF (SEQ ID NO:21), and the $V_{L3}$ domain comprises a CDR-L1 sequence comprising the amino acid sequence of QSVISRF (SEQ ID NO:22), a CDR-L2 sequence comprising the amino acid sequence of GAS (SEQ ID NO:23), and a CDR-L3 sequence comprising the amino acid sequence of QQDSNLPIT (SEQ ID NO:24). In some embodiments, the $V_{H3}$ domain comprises a CDR-H1 sequence comprising the amino acid sequence of GYAFTTYL (SEQ ID NO:25), a CDR-H2 sequence comprising the amino acid sequence of INPGSGST (SEQ ID NO:26), and a CDR-H3 sequence comprising the amino acid sequence of ARYAYGY (SEQ ID NO:27), and the $V_{L3}$ domain comprises a CDR-L1 sequence comprising the amino acid sequence of QNVGTA (SEQ ID NO:28), a CDR-L2 sequence comprising the amino acid sequence of SAS (SEQ ID NO:29), and a CDR-L3 sequence comprising the amino acid sequence of QQYSTYPFT (SEQ ID NO:30). In some embodiments, the $V_{H3}$ domain comprises a CDR-H1 sequence comprising the amino acid sequence of GYSFTNYA (SEQ ID NO:31), a CDR-H2 sequence comprising the amino acid sequence of ISPYYGDT (SEQ ID NO:32), and a CDR-H3 sequence comprising the amino acid sequence of ARRFEGFYYSMDY (SEQ ID NO:33), and the $V_{L3}$ domain comprises a CDR-L1 sequence comprising the amino acid sequence of QSLVHSNGNTY (SEQ ID NO:34), a CDR-L2 sequence comprising the amino acid sequence of KVS (SEQ ID NO:35), and a CDR-L3 sequence comprising the amino acid sequence of SQSTHVPLT (SEQ ID NO:36).

In some embodiments, the $V_{H3}$ domain comprises a CDR-H1 sequence comprising the amino acid sequence of GFTFSSYG (SEQ ID NO:37), a CDR-H2 sequence comprising the amino acid sequence of IWYDGSNK (SEQ ID NO:38), and a CDR-H3 sequence comprising the amino acid sequence of ARDPGLRYFDGGMDV (SEQ ID NO:39), and the $V_{L3}$ domain comprises a CDR-L1 sequence comprising the amino acid sequence of QGISSY (SEQ ID NO:40), a CDR-L2 sequence comprising the amino acid sequence of AAS (SEQ ID NO:41), and a CDR-L3 sequence comprising the amino acid sequence of QQLNSFPYT (SEQ ID NO:42). In some embodiments, the $V_{H3}$ domain comprises a CDR-H1 sequence comprising the amino acid sequence of GFTFSSYG (SEQ ID NO:43), a CDR-H2 sequence comprising the amino acid sequence of IWYDGSNK (SEQ ID NO:44), and a CDR-H3 sequence comprising the amino acid sequence of ARMFRGAFDY (SEQ ID NO:45), and the $V_{L3}$ domain comprises a CDR-L1 sequence comprising the amino acid sequence of QGIRND (SEQ ID NO:46), a CDR-L2 sequence comprising the amino acid sequence of AAS (SEQ ID NO:47), and a CDR-L3 sequence comprising the amino acid sequence of LQDYIYYPT (SEQ ID NO:48). In some embodiments, the $V_{H3}$ domain comprises the amino acid sequence of QVQLVQSGAEVVKPGASVKVSCKASGYTFTSYAMHWVKEAPGQRLEWIGYIYPG QGGTNYNQKFQGRATLTADTSASTAYMELSSLRSEDTAVYFCARTGGLRRAYFTY WGQGTLVTVSS (SEQ ID NO:79), and/or the $V_{L3}$ domain comprises the amino acid sequence of DIVLTQSPATLSLSPGERATISCRASQSVSSYGQGFMHWYQQKPGQPPRLLIYGASS RATGIPARFSGSGSGTDFTLTISPLEPEDFAVYYCQQNKEDPWTFGGGTKLEIK (SEQ ID NO:80). In some embodiments, the $V_{H3}$ domain comprises the amino acid sequence of QVQLVQSGAEVKKPGASVKVSCKVSGYTLTEFSIHWVRQAPGQGLEWMGGFDPE DGETIYAQKFQGRVIMTEDTSTDTAYMEMNSLRSEDTAIYYCTTGRFFDWFWGQG TLVTVSS (SEQ ID NO:81), and/or the $V_{L3}$ domain comprises the amino acid sequence of EIILTQSPAILSLSPGERATLSCRASQSVISRFLSWYQVKPGLAPRLLIYGASTRATGIP VRFSGSGSGTDFSLTISSLQPEDCAVYYCQQDSNLPITFGQGTRLEIK (SEQ ID NO:82). In some embodiments, the $V_{H3}$ domain comprises the amino acid sequence of QVQLVQSGAEVKKPGASVKVSCKASGYAFTTYL-VEWIRQRPGQGLEWMGVINPG SGSTNYAQKFQGRVTMTVDRSST-TAYMELSRLRSDDTAVYYCARYAYGYWGQG TLVTVSS (SEQ ID NO:83), and/or the $V_{L3}$ domain comprises the amino acid sequence of DIQMTQSPSSL-SASVGDRVTITCRASQNVGTAVAWYQQKPGK-SPKQLIYSASNRYT GVPSRFSGSGSGTDFTLTISSLQPED-LATYYCQQYSTYPFTFGQGTKLEIK (SEQ ID NO:84). In some embodiments, the $V_{H3}$ domain comprises the amino acid sequence of QVQLVESGGGVVQPGRSLRLS-CAASGFTFSSYGMYWVRQAPGKGLEWVAVIWYD GSNKYYADSVKGRFTISRDNSKNTLYLQMNSLRAE-DTAVYHCARDPGLRYFDGG MDVWGQGTTVTVSS (SEQ ID NO:87), and/or the $V_{L3}$ domain comprises the amino acid sequence of DIQLTQSPSFLSASVGDRVTIT-CRASQGISSYLAWYQQKPGKAPKLLIFAASTLHSG VPSRFSGSGSGTEFTLTISSLQPEDFA-TYYCQQLNSFPYTFGQGTKLEIK (SEQ ID NO:88). In some embodiments, the $V_{H3}$ domain comprises the amino acid sequence of QVQLVESGGGVVQPGRSLRLS-CAASGFTFSSYGMHWVRQAPGKGLEWVAVIWYD GSNKYYADSVKGRFTISGDNSKNTLYLQMNSLRAE-DTAVYYCARMFRGAFDYWG QGTLVTVSS (SEQ ID NO:89), and/or the $V_{L3}$ domain comprises the amino acid sequence of AIQMTQSPSSLSASVGDRVTITCRASQ-GIRNDLGWYQQKPGKAPKLLIYAASSLQS GVPSRFSGSGSGTDFTLTISGLQPEDSATYY-CLQDYIYYPTFGQGTKVEIK (SEQ ID NO:90). In some embodiments, the $V_{H3}$ domain comprises the amino acid sequence of QVQLVQSGAEVKKPGASVKVSCK-ASGYSFTNYAVHWVRQAPGQGLEWMGVISPY YGDT-TYAQKFQGRVTMTVDKSSSTAYMELSRLRSDD-TAVYYCARRFEGFYYSMD YWGQGTLVTVSS (SEQ ID NO:85), and/or the $V_{L3}$ domain comprises the amino acid sequence of DVVMTQSPLSLPVTLGQPASISCRP-SQSLVHSNGNTYLNWYQQRPGQSPKLLIYKV SKRFSGVPDRFSGSGSGTDFTLKISRVEAE-DVGVYYCSQSTHVPLTFGGGTKVEIK (SEQ ID NO:86).

In some embodiments, the first polypeptide chain comprises the amino acid sequence of SEQ ID NO:156 or an amino acid sequence that is at least 95% identical to the amino acid sequence of SEQ ID NO:156; the second polypeptide chain comprises the amino acid sequence of SEQ ID NO:157 or an amino acid sequence that is at least 95% identical to the amino acid sequence of SEQ ID NO:157; the third polypeptide chain comprises the amino acid sequence of SEQ ID NO:158 or an amino acid sequence that is at least 95% identical to the amino acid sequence of SEQ ID NO:158; and the fourth polypeptide chain comprises the amino acid sequence of SEQ ID NO:159 or an amino acid sequence that is at least 95% identical to the amino acid sequence of SEQ ID NO:159. In some embodiments, the first polypeptide chain comprises the amino acid sequence of SEQ ID NO:160 or an amino acid sequence that is at least 95% identical to the amino acid sequence of SEQ ID NO:160; the second polypeptide chain comprises the amino acid sequence of SEQ ID NO:161 or an amino acid sequence that is at least 95% identical to the amino acid sequence of SEQ ID NO:161; the third polypeptide chain comprises the amino acid sequence of SEQ ID NO:162 or an amino acid sequence that is at least 95% identical to the amino acid sequence of SEQ ID NO:162; and the fourth polypeptide chain comprises the amino acid sequence of SEQ ID NO:163 or an amino acid sequence that is at least 95% identical to the amino acid sequence of SEQ ID NO:163. In some embodiments, the first polypeptide chain comprises the amino acid sequence of SEQ ID NO:164 or an amino acid sequence that is at least 95% identical to the amino acid sequence of SEQ ID NO:164; the second polypeptide chain comprises the amino acid sequence of SEQ ID NO:165 or an amino acid sequence that is at least 95% identical to the amino acid sequence of SEQ ID NO:165; the third polypeptide chain comprises the amino acid sequence of SEQ ID NO:166 or an amino acid sequence that is at least 95% identical to the amino acid sequence of SEQ ID NO:166; and the fourth polypeptide chain comprises the amino acid sequence of SEQ ID NO:167 or an amino acid sequence that is at least 95% identical to the amino acid sequence of SEQ ID NO:167. In some embodiments, the first polypeptide chain comprises the amino acid sequence of SEQ ID NO:168 or an amino acid sequence that is at least 95% identical to the amino acid sequence of SEQ ID NO:168; the second polypeptide chain comprises the amino acid sequence of SEQ ID NO:169 or an amino acid sequence that is at least 95% identical to the amino acid sequence of SEQ ID NO:169; the third polypeptide chain comprises the amino acid sequence of SEQ ID NO:170 or an amino acid sequence that is at least 95% identical to the amino acid sequence of SEQ ID NO:170; and the fourth polypeptide chain comprises the amino acid sequence of SEQ ID NO:171 or an amino acid sequence that is at least 95% identical to the amino acid sequence of SEQ ID NO:171. In some embodiments, the first polypeptide chain comprises the amino acid sequence of SEQ ID NO:172 or an amino acid sequence that is at least 95% identical to the amino acid sequence of SEQ ID NO:172; the second polypeptide chain comprises the amino acid sequence of SEQ ID NO:173 or an amino acid sequence that is at least 95% identical to the amino acid sequence of SEQ ID NO:173; the third polypeptide chain comprises the amino acid sequence of SEQ ID NO:174 or an amino acid sequence that is at least 95% identical to the amino acid sequence of SEQ ID NO:174; and the fourth polypeptide chain comprises the amino acid sequence of SEQ ID NO:175 or an amino acid sequence that is at least 95% identical to the amino acid sequence of SEQ ID NO:175. In some embodiments, the first polypeptide chain comprises the amino acid sequence of SEQ ID NO:176 or an amino acid sequence that is at least 95% identical to the amino acid sequence of SEQ ID NO:176; the second polypeptide chain comprises the amino acid sequence of SEQ ID NO:177 or an amino acid sequence that is at least 95% identical to the amino acid sequence of SEQ ID NO:177; the third polypeptide chain comprises the amino acid sequence of SEQ ID NO:178 or an amino acid sequence that is at least 95% identical to the amino acid sequence of SEQ ID NO:178; and the fourth polypeptide chain comprises the amino acid sequence of SEQ ID NO:179 or an amino acid sequence that is at least 95% identical to the amino acid sequence of SEQ ID NO:179. In some embodiments, the first polypeptide chain comprises the amino acid sequence of SEQ ID NO:181 or an amino acid sequence that is at least 95% identical to the amino acid sequence of SEQ ID NO:181; the second polypeptide chain comprises the amino acid sequence of SEQ ID NO:182 or an amino acid sequence that is at least 95% identical to the amino acid sequence of SEQ ID NO:182; the third polypeptide chain comprises the amino acid sequence of SEQ ID NO:183 or an amino acid sequence that is at least 95% identical to the amino acid sequence of SEQ ID NO:183; and the fourth polypeptide chain comprises the amino acid sequence of SEQ ID NO:184 or an amino acid sequence that is at least 95% identical to the amino acid sequence of SEQ ID NO:184. In some embodiments, the first polypeptide chain comprises the amino acid sequence of SEQ ID NO:185 or an amino acid sequence that is at least 95% identical to the amino acid sequence of SEQ ID NO:185; the second polypeptide chain comprises the amino acid sequence of SEQ ID NO:186 or an amino acid sequence that is at least 95% identical to the amino acid sequence of SEQ ID NO:186; the third polypeptide chain comprises the amino acid sequence of SEQ ID NO:187 or an amino acid sequence that is at least 95% identical to the amino acid sequence of SEQ ID NO:187; and the fourth polypeptide chain comprises the amino acid sequence of SEQ ID NO:188 or an amino acid sequence that is at least 95% identical to the amino acid sequence of SEQ ID NO:188.

In some embodiments, the third antigen binding site binds a human HER2 polypeptide. In some embodiments, the $V_{H3}$ domain comprises a CDR-H1 sequence comprising the amino acid sequence of GFNIKDTY (SEQ ID NO:1) or GFNIRDTY (SEQ ID NO:2), a CDR-H2 sequence comprising the amino acid sequence of IYPTNGYT (SEQ ID NO:3), IYPTQGYT (SEQ ID NO:4), or IYPTNAYT (SEQ ID NO:5), and a CDR-H3 sequence comprising the amino acid sequence of SRWGGDGFYAMDY (SEQ ID NO:6), SRWGGEGFYAMDY (SEQ ID NO:7), or SRWGGSGFYAMDY (SEQ ID NO:8), and the $V_{L3}$ domain comprises a CDR-L1 sequence comprising the amino acid sequence of QDVNTA (SEQ ID NO:9) or QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, the $V_{H3}$ domain comprises a CDR-H1 sequence comprising the amino acid sequence of GFNIKDTY (SEQ ID NO:1), a CDR-H2 sequence comprising the amino acid sequence of IYPTNGYT (SEQ ID NO:3), and a CDR-H3 sequence comprising the amino acid sequence of SRWGGDGFYAMDY (SEQ ID NO:6), and the $V_{L3}$ domain comprises a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, the $V_{H3}$ domain comprises a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGEGFYAMDY (SEQ ID NO:7), and the $V_{L3}$ domain comprises a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, the $V_{H3}$ domain comprises a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGSGFYAMDY (SEQ ID NO:8), and the $V_{L3}$ domain comprises a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, the $V_{H3}$ domain comprises a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGSGFYAMDY (SEQ ID NO:8), and the $V_{L3}$ domain comprises a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, the $V_{H3}$ domain comprises a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGEGFYAMDY (SEQ ID NO:7), and the $V_{L3}$ domain comprises a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, the $V_{H3}$ domain comprises a CDR-H1 sequence comprising the amino acid sequence of GFNIKDTY (SEQ ID NO:1), a CDR-H2 sequence comprising the amino acid sequence of IYPTNGYT (SEQ ID NO:3), and a CDR-H3 sequence comprising the amino acid sequence of SRWGGDGFYAMDY (SEQ ID NO:6), and the $V_{L3}$ domain comprises a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, the $V_{H3}$ domain comprises the amino acid sequence of EVQLVESGGGLVQPGGSLRLS-CAASGFNIKDTYIHWVRQAPGKGLEWVARIYPTN GYTRYADSVKGRFTISADTSKNTAYLQMNSLRAED-TAVYYCSRWGGDGFYAMDY WGQGTLVTVSS (SEQ ID NO:72), EVQLVESGGGLVQPGGSLRLS-CAASGFNIRDTYIHWVRQAPGKGLEWVARIYPTQ GYTRYADSVKGRFTISADTSKNTAYLQMNSLRAED-TAVYYCSRWGGEGFYAMDY WGQGTLVTVSS (SEQ ID NO:73), EVQLVESGGGLVQPGGSLRLS-CAASGFNIRDTYIHWVRQAPGKGLEWVARIYPTQ GYTRYADSVKGRFTISADTSKNTAYLQMNSLRAED-TAVYYCSRWGGSGFYAMDY WGQGTLVTVSS (SEQ ID NO:74), EVQLVESGGGLVQPGGSLRLS-CAASGFNIRDTYIHWVRQAPGKGLEWVARIYPTN AYTRYADSVKGRFTISADTSKNTAYLQMNSLRAED-TAVYYCSRWGGSGFYAMDY WGQGTLVTVSS (SEQ ID NO:75), or EVQLVESGGGLVQPGGSLRLS-CAASGFNIRDTYIHWVRQAPGKGLEWVARIYPTN AYTRYADSVKGRFTISADTSKNTAYLQMNSLRAED-TAVYYCSRWGGEGFYAMDY WGQGTLVTVSS (SEQ ID NO:76), and/or the $V_{L3}$ domain comprises the amino acid sequence of DIQMTQSPSSLSASVGDRVTIT-CRASQDVNTAVAWYQQKPGKAPKLLIYSASFLYS GVPSRFSGSRSGTDFTLTISSLQPEDFA-TYYCQQHYTTPPTFGQGTKVEIK (SEQ ID NO:77) or DIQMTQSPSSLSASVGDRVTITCRASQDVQTA-VAWYQQKPGKAPKLLIYSASFLYS GVPSRFSGSRSGTDFTLTISSLQPEDFA-TYYCQQHYTTPPTFGQGTKVEIK (SEQ ID NO:78). In some embodiments, the $V_{H3}$ domain comprises the amino acid sequence of EVQLVESGGGLVQPGGSLRLS-CAASGFNIKDTYIHWVRQAPGKGLEWVARIYPTN GYTRYADSVKGRFTISADTSKNTAYLQMNSLRAED-TAVYYCSRWGGDGFYAMDY WGQGTLVTVSS (SEQ ID NO:72), and/or the $V_{L3}$ domain comprises the amino acid sequence of DIQMTQSPSSLSASVGDRVTIT-CRASQDVNTAVAWYQQKPGKAPKLLIYSASFLYS GVPSRFSGSRSGTDFTLTISSLQPEDFA-TYYCQQHYTTPPTFGQGTKVEIK (SEQ ID NO:77). In some embodiments, the $V_{H3}$ domain comprises the amino acid sequence of EVQLVESGGGLVQPGGSLRLS-CAASGFNIRDTYIHWVRQAPGKGLEWVARIYPTQ GYTRYADSVKGRFTISADTSKNTAYLQMNSLRAED-TAVYYCSRWGGEGFYAMDY WGQGTLVTVSS (SEQ ID NO:73), and/or the $V_{L3}$ domain comprises the amino acid sequence of DIQMTQSPSSLSASVGDRVTIT-CRASQDVNTAVAWYQQKPGKAPKLLIYSASFLYS GVPSRFSGSRSGTDFTLTISSLQPEDFA-TYYCQQHYTTPPTFGQGTKVEIK (SEQ ID NO:77). In some embodiments, the $V_{H3}$ domain comprises the amino acid sequence of EVQLVESGGGLVQPGGSLRLS-CAASGFNIRDTYIHWVRQAPGKGLEWVARIYPTN AYTRYADSVKGRFTISADTSKNTAYLQMNSLRAED-TAVYYCSRWGGSGFYAMDY WGQGTLVTVSS (SEQ ID NO:75), and/or the $V_{L3}$ domain comprises the amino acid sequence of DIQMTQSPSSLSASVGDRVTIT-CRASQDVNTAVAWYQQKPGKAPKLLIYSASFLYS GVPSRFSGSRSGTDFTLTISSLQPEDFA-TYYCQQHYTTPPTFGQGTKVEIK (SEQ ID NO:77). In some embodiments, the $V_{H3}$ domain comprises the amino acid sequence of EVQLVESGGGLVQPGGSLRLS-CAASGFNIRDTYIHWVRQAPGKGLEWVARIYPTQ GYTRYADSVKGRFTISADTSKNTAYLQMNSLRAED-TAVYYCSRWGGSGFYAMDY WGQGTLVTVSS (SEQ ID NO:74), and/or the $V_{L3}$ domain comprises the amino acid sequence of DIQMTQSPSSLSASVGDRVTIT-CRASQDVNTAVAWYQQKPGKAPKLLIYSASFLYS GVPSRFSGSRSGTDFTLTISSLQPEDFA-TYYCQQHYTTPPTFGQGTKVEIK (SEQ ID NO:77). In some embodiments, the $V_{H3}$ domain comprises the amino acid sequence of EVQLVESGGGLVQPGGSLRLS-CAASGFNIRDTYIHWVRQAPGKGLEWVARIYPTN AYTRYADSVKGRFTISADTSKNTAYLQMNSLRAED-TAVYYCSRWGGEGFYAMDY WGQGTLVTVSS (SEQ ID NO:76), and/or the $V_{L3}$ domain comprises the amino acid sequence of DIQMTQSPSSLSASVGDRVTIT-CRASQDVNTAVAWYQQKPGKAPKLLIYSASFLYS GVPSRFSGSRSGTDFTLTISSLQPEDFA-TYYCQQHYTTPPTFGQGTKVEIK (SEQ ID NO:77). In some embodiments, the $V_{H3}$ domain comprises the amino acid sequence of EVQLVESGGGLVQPGGSLRLS-CAASGFNIKDTYIHWVRQAPGKGLEWVARIYPTN GYTRYADSVKGRFTISADTSKNTAYLQMNSLRAED-TAVYYCSRWGGDGFYAMDY WGQGTLVTVSS (SEQ ID NO:72), and/or the $V_{L3}$ domain comprises the amino acid sequence of DIQMTQSPSSLSASVGDRVTIT-CRASQDVQTAVAWYQQKPGKAPKLLIYSASFLYS GVPSRFSGSRSGTDFTLTISSLQPEDFA-TYYCQQHYTTPPTFGQGTKVEIK (SEQ ID NO:78).

In some embodiments, the first polypeptide chain comprises the amino acid sequence of SEQ ID NO:100 or an amino acid sequence that is at least 95% identical to the amino acid sequence of SEQ ID NO:100; the second polypeptide chain comprises the amino acid sequence of SEQ ID NO:101 or an amino acid sequence that is at least 95% identical to the amino acid sequence of SEQ ID NO:101; the third polypeptide chain comprises the amino acid sequence of SEQ ID NO:102 or an amino acid sequence that is at least 95% identical to the amino acid sequence of SEQ ID NO:102; and the fourth polypeptide chain comprises the amino acid sequence of SEQ ID NO:103 or an amino acid sequence that is at least 95% identical to the amino acid sequence of SEQ ID NO:103. In some embodiments, the first polypeptide chain comprises the amino acid sequence of SEQ ID NO:104 or an amino acid sequence that is at least 95% identical to the amino acid sequence of SEQ ID NO:104; the second polypeptide chain comprises the amino acid sequence of SEQ ID NO:105 or an amino acid sequence that is at least 95% identical to the amino acid sequence of SEQ ID NO:105; the third polypeptide chain comprises the amino acid sequence of SEQ ID NO:106 or an amino acid sequence that is at least 95% identical to the amino acid sequence of SEQ ID NO:106; and the fourth polypeptide chain comprises the amino acid sequence of SEQ ID NO:107 or an amino acid sequence that is at least 95% identical to the amino acid sequence of SEQ ID NO:107. In some embodiments, the first polypeptide chain comprises the amino acid sequence of SEQ ID NO:112 or an amino acid sequence that is at least 95% identical to the amino acid sequence of SEQ ID NO:112; the second polypeptide chain comprises the amino acid sequence of SEQ ID NO:113 or an amino acid sequence that is at least 95% identical to the amino acid sequence of SEQ ID NO:113; the third polypeptide chain comprises the amino acid sequence of SEQ ID NO:114 or an amino acid sequence that is at least 95% identical to the amino acid sequence of SEQ ID NO:114; and the fourth polypeptide chain comprises the amino acid sequence of SEQ ID NO:115 or an amino acid sequence that is at least 95% identical to the amino acid sequence of SEQ ID NO:115. In some embodiments, the first polypeptide chain comprises the amino acid sequence of SEQ ID NO:116 or an amino acid sequence that is at least 95% identical to the amino acid sequence of SEQ ID NO:116; the second polypeptide chain comprises the amino acid sequence of SEQ ID NO:117 or an amino acid sequence that is at least 95% identical to the amino acid sequence of SEQ ID NO:117; the third polypeptide chain comprises the amino acid sequence of SEQ ID NO:118 or an amino acid sequence that is at least 95% identical to the amino acid sequence of SEQ ID NO:118; and the fourth polypeptide chain comprises the amino acid sequence of SEQ ID NO:119 or an amino acid sequence that is at least 95% identical to the amino acid sequence of SEQ ID NO:119. In some embodiments, the first polypeptide chain comprises the amino acid sequence of SEQ ID NO:120 or an amino acid sequence that is at least 95% identical to the amino acid sequence of SEQ ID NO:120; the second polypeptide chain comprises the amino acid sequence of SEQ ID NO:121 or an amino acid sequence that is at least 95% identical to the amino acid sequence of SEQ ID NO:121; the third polypeptide chain comprises the amino acid sequence of SEQ ID NO:122 or an amino acid sequence that is at least 95% identical to the amino acid sequence of SEQ ID NO:122; and the fourth polypeptide chain comprises the amino acid sequence of SEQ ID NO:123 or an amino acid sequence that is at least 95% identical to the amino acid sequence of SEQ ID NO:123. In some embodiments, the first polypeptide chain comprises the amino acid sequence of SEQ ID NO:124 or an amino acid sequence that is at least 95% identical to the amino acid sequence of SEQ ID NO:124; the second polypeptide chain comprises the amino acid sequence of SEQ ID NO:125 or an amino acid sequence that is at least 95% identical to the amino acid sequence of SEQ ID NO:125; the third polypeptide chain comprises the amino acid sequence of SEQ ID NO:126 or an amino acid sequence that is at least 95% identical to the amino acid sequence of SEQ ID NO:126; and the fourth polypeptide chain comprises the amino acid sequence of SEQ ID NO:127 or an amino acid sequence that is at least 95% identical to the amino acid sequence of SEQ ID NO:127. In some embodiments, the first polypeptide chain comprises the amino acid sequence of SEQ ID NO:128 or an amino acid sequence that is at least 95% identical to the amino acid sequence of SEQ ID NO:128; the second polypeptide chain comprises the amino acid sequence of SEQ ID NO:129 or an amino acid sequence that is at least 95% identical to the amino acid sequence of SEQ ID NO:129; the third polypeptide chain comprises the amino acid sequence of SEQ ID NO:130 or an amino acid sequence that is at least 95% identical to the amino acid sequence of SEQ ID NO:130; and the fourth polypeptide chain comprises the amino acid sequence of SEQ ID NO:131 or an amino acid sequence that is at least 95% identical to the amino acid sequence of SEQ ID NO:131. In some embodiments, the first polypeptide chain comprises the amino acid sequence of SEQ ID NO:132 or an amino acid sequence that is at least 95% identical to the amino acid sequence of SEQ ID NO:132; the second polypeptide chain comprises the amino acid sequence of SEQ ID NO:133 or an amino acid sequence that is at least 95% identical to the amino acid sequence of SEQ ID NO:133; the third polypeptide chain comprises the amino acid sequence of SEQ ID NO:134 or an amino acid sequence that is at least 95% identical to the amino acid sequence of SEQ ID NO:134; and the fourth polypeptide chain comprises the amino acid sequence of SEQ ID NO:135 or an amino acid sequence that is at least 95% identical to the amino acid sequence of SEQ ID NO:135. In some embodiments, the first polypeptide chain comprises the amino acid sequence of SEQ ID NO:136 or an amino acid sequence that is at least 95% identical to the amino acid sequence of SEQ ID NO:136; the second polypeptide chain comprises the amino acid sequence of SEQ ID NO:137 or an amino acid sequence that is at least 95% identical to the amino acid sequence of SEQ ID NO:137; the third polypeptide chain comprises the amino acid sequence of SEQ ID NO:138 or an amino acid sequence that is at least 95% identical to the amino acid sequence of SEQ ID NO:138; and the fourth polypeptide chain comprises the amino acid sequence of SEQ ID NO:139 or an amino acid sequence that is at least 95% identical to the amino acid sequence of SEQ ID NO:139. In some embodiments, the first polypeptide chain comprises the amino acid sequence of SEQ ID NO:140 or an amino acid sequence that is at least 95% identical to the amino acid sequence of SEQ ID NO:140; the second polypeptide chain comprises the amino acid sequence of SEQ ID NO:141 or an amino acid sequence that is at least 95% identical to the amino acid sequence of SEQ ID NO:141; the third polypeptide chain comprises the amino acid sequence of SEQ ID NO:142 or an amino acid sequence that is at least 95% identical to the amino acid sequence of SEQ ID NO:142; and the fourth polypeptide chain comprises the amino acid sequence of SEQ ID NO:143 or an amino acid sequence that is at least 95% identical to the amino acid sequence of SEQ ID NO:143. In some embodiments, the first polypeptide chain comprises the amino acid sequence of SEQ ID NO:144 or an amino acid sequence that is at least 95% identical to the amino acid sequence of SEQ ID NO:144; the second polypeptide chain comprises the amino acid sequence of SEQ ID NO:145 or an amino acid sequence that is at least 95% identical to the amino acid sequence of SEQ ID NO:145; the third polypeptide chain comprises the amino acid sequence of SEQ ID NO:146 or an amino acid sequence that is at least 95% identical to the amino acid sequence of SEQ ID NO:146; and the fourth polypeptide chain comprises the amino acid sequence of SEQ ID NO:147 or an amino acid sequence that is at least 95% identical to the amino acid sequence of SEQ ID NO:147. In some embodiments, the first polypeptide chain comprises the amino acid sequence of SEQ ID NO:148 or an amino acid sequence that is at least 95% identical to the amino acid sequence of SEQ ID NO:148; the second polypeptide chain comprises the amino acid sequence of SEQ ID NO:149 or an amino acid sequence that is at least 95% identical to the amino acid sequence of SEQ ID NO:149; the third polypeptide chain comprises the amino acid sequence of SEQ ID NO:150 or an amino acid sequence that is at least 95% identical to the amino acid sequence of SEQ ID NO:150; and the fourth polypeptide chain comprises the amino acid sequence of SEQ ID NO:151 or an amino acid sequence that is at least 95% identical to the amino acid sequence of SEQ ID NO:151. In some embodiments, the first polypeptide chain comprises the amino acid sequence of SEQ ID NO:152 or an amino acid sequence that is at least 95% identical to the amino acid sequence of SEQ ID NO:152; the second polypeptide chain comprises the amino acid sequence of SEQ ID NO:153 or an amino acid sequence that is at least 95% identical to the amino acid sequence of SEQ ID NO:153; the third polypeptide chain comprises the amino acid sequence of SEQ ID NO:154 or an amino acid sequence that is at least 95% identical to the amino acid sequence of SEQ ID NO:154; and the fourth polypeptide chain comprises the amino acid sequence of SEQ ID NO:155 or an amino acid sequence that is at least 95% identical to the amino acid sequence of SEQ ID NO:155. In some embodiments, the first polypeptide chain comprises the amino acid sequence of SEQ ID NO:286 or an amino acid sequence that is at least 95% identical to the amino acid sequence of SEQ ID NO:286; the second polypeptide chain comprises the amino acid sequence of SEQ ID NO:287 or an amino acid sequence that is at least 95% identical to the amino acid sequence of SEQ ID NO:287; the third polypeptide chain comprises the amino acid sequence of SEQ ID NO:288 or an amino acid sequence that is at least 95% identical to the amino acid sequence of SEQ ID NO:288; and the fourth polypeptide chain comprises the amino acid sequence of SEQ ID NO:289 or an amino acid sequence that is at least 95% identical to the amino acid sequence of SEQ ID NO:289. In some embodiments, the first polypeptide chain comprises the amino acid sequence of SEQ ID NO:290 or an amino acid sequence that is at least 95% identical to the amino acid sequence of SEQ ID NO:290; the second polypeptide chain comprises the amino acid sequence of SEQ ID NO:291 or an amino acid sequence that is at least 95% identical to the amino acid sequence of SEQ ID NO:291; the third polypeptide chain comprises the amino acid sequence of SEQ ID NO:292 or an amino acid sequence that is at least 95% identical to the amino acid sequence of SEQ ID NO:292; and the fourth polypeptide chain comprises the amino acid sequence of SEQ ID NO:293 or an amino acid sequence that is at least 95% identical to the amino acid sequence of SEQ ID NO:293. In some embodiments, the first polypeptide chain comprises the amino acid sequence of SEQ ID NO:294 or an amino acid sequence that is at least 95% identical to the amino acid sequence of SEQ ID NO:294; the second polypeptide chain comprises the amino acid sequence of SEQ ID NO:295 or an amino acid sequence that is at least 95% identical to the amino acid sequence of SEQ ID NO:295; the third polypeptide chain comprises the amino acid sequence of SEQ ID NO:296 or an amino acid sequence that is at least 95% identical to the amino acid sequence of SEQ ID NO:296; and the fourth polypeptide chain comprises the amino acid sequence of SEQ ID NO:297 or an amino acid sequence that is at least 95% identical to the amino acid sequence of SEQ ID NO:297. In some embodiments, the first polypeptide chain comprises the amino acid sequence of SEQ ID NO:298 or an amino acid sequence that is at least 95% identical to the amino acid sequence of SEQ ID NO:298; the second polypeptide chain comprises the amino acid sequence of SEQ ID NO:299 or an amino acid sequence that is at least 95% identical to the amino acid sequence of SEQ ID NO:299; the third polypeptide chain comprises the amino acid sequence of SEQ ID NO:300 or an amino acid sequence that is at least 95% identical to the amino acid sequence of SEQ ID NO:300; and the fourth polypeptide chain comprises the amino acid sequence of SEQ ID NO:301 or an amino acid sequence that is at least 95% identical to the amino acid sequence of SEQ ID NO:301.

In some embodiments that may be combined with any other embodiments described herein, at least one of $L_1$, $L_2$, $L_3$ or $L_4$ is independently 0 amino acids in length. In some embodiments, $L_1$, $L_2$, $L_3$ and $L_4$ each independently are zero amino acids in length or comprise a sequence selected from the group consisting of GGGGSGGGGS (SEQ ID NO:69), GGGGSGGGGSGGGGS (SEQ ID NO: 70), S, RT, TKGPS (SEQ ID NO: 68), GQPKAAP (SEQ ID NO: 67), and GGSGSSGSGG (SEQ ID NO: 71). In some embodiments, $L_1$, $L_2$, $L_3$ and $L_4$ each independently comprise a sequence selected from the group consisting of GGGGSGGGGS (SEQ ID NO:69), GGGGSGGGGSGGGGS (SEQ ID NO:70), S, RT, TKGPS (SEQ ID NO:68), GQPKAAP (SEQ ID NO: 67), and GGSGSSGSGG (SEQ ID NO:71). In some embodiments, $L_1$ comprises the sequence GQPKAAP (SEQ ID NO: 67), $L_2$ comprises the sequence TKGPS (SEQ ID NO:68), $L_3$ comprises the sequence S, and $L_4$ comprises the sequence RT. In some embodiments, at least one of $L_1$, $L_2$, $L_3$ or $L_4$ comprises the sequence DKTHT (SEQ ID NO:66). In some embodiments, $L_1$, $L_2$, $L_3$ and $L_4$ comprise the sequence DKTHT (SEQ ID NO:66).

In some embodiments that may be combined with any other embodiments described herein, the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 234 and 235 of human IgG4 according to EU Index, wherein the amino acid substitutions are F234A and L235A. In some embodiments, the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 233-236 of human IgG4 according to EU Index, wherein the amino acid substitutions are E233P, F234V, L235A, and a deletion at 236. In some embodiments, the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 228 and 409 of human IgG4 according to EU Index, wherein the amino acid substitutions are S228P and R409K. In some embodiments, the hinge-$C_{H2}$-$C_{H3}$ domains of the second and the third polypeptide chains are human IgG1 hinge-$C_{H2}$-$C_{H3}$ domains, and wherein the hinge-$C_{H2}$-$C_{H3}$ domains each comprise amino acid substitutions at positions corresponding to positions 234, 235, and 329 of human IgG1 according to EU Index, wherein the amino acid substitutions are L234A, L235A, and P329A. In some embodiments, the hinge-$C_{H2}$-$C_{H3}$ domains of the second and the third polypeptide chains are human IgG hinge-$C_{H2}$-$C_{H3}$ domains, and wherein the hinge-$C_{H2}$-$C_{H3}$ domains each comprise amino acid substitutions at positions corresponding to positions 298, 299, and 300 of human IgG1 according to EU Index, wherein the amino acid substitutions are S298N, T299A, and Y300S. In some embodiments, the hinge-$C_{H2}$-$C_{H3}$ domain of the second polypeptide chain comprises amino acid substitutions at positions corresponding to positions 349, 366, 368, and 407 of human IgG1 or IgG4 according to EU Index, wherein the amino acid substitutions are Y349C, T366S, L368A, and Y407V; and wherein the hinge-$C_{H2}$-$C_{H3}$ domain of the third polypeptide chain comprises amino acid substitutions at positions corresponding to positions 354 and 366 of human IgG1 or IgG4 according to EU Index, wherein the amino acid substitutions are S354C and T366W. In some embodiments, the hinge-$C_{H2}$-$C_{H3}$ domain of the second polypeptide chain comprises amino acid substitutions at positions corresponding to positions 354 and 366 of human IgG1 or IgG4 according to EU Index, wherein the amino acid substitutions are S354C and T366W; and wherein the hinge-$C_{H2}$-$C_{H3}$ domain of the third polypeptide chain comprises amino acid substitutions at positions corresponding to positions 349, 366, 368, and 407 of human IgG1 or IgG4 according to EU Index, wherein the amino acid substitutions are Y349C, T366S, L368A, and Y407V.

In some embodiments, provided herein are isolated nucleic acid molecules comprising a nucleotide sequence encoding the binding protein of any one of the above embodiments. In some embodiments, provided herein are expression vectors comprising the nucleic acid molecule of any one of the above embodiments. In some embodiments, provided herein are isolated host cells comprising the nucleic acid molecule of any one of the above embodiments or the expression vector of any one of the above embodiments. In some embodiments, the host cell is a mammalian or insect cell.

In some embodiments, provided herein are pharmaceutical compositions comprising the binding protein of any one of the above embodiments and a pharmaceutically acceptable carrier.

In some embodiments, provided herein are methods of preventing and/or treating cancer in a patient comprising administering to the patient a therapeutically effective amount of at least one binding protein or pharmaceutical composition of any one of the above embodiments. In some embodiments, provided herein is a binding protein or pharmaceutical composition according to any one of the above embodiments for use in a method of preventing and/or treating cancer in a patient, wherein the method comprises administering to the patient a therapeutically effective amount of the binding protein or pharmaceutical composition. In some embodiments, provided herein is a binding protein or pharmaceutical composition according to any one of the above embodiments for use in manufacturing a medicament for preventing and/or treating cancer in a patient.

In some embodiments, the at least one binding protein is co-administered with a chemotherapeutic agent. In some embodiments, the patient is a human.

In some embodiments, the third antigen binding site binds a human CD38 polypeptide, and wherein cancer cells from the individual or patient express CD38. In some embodiments, the cancer is multiple myeloma. In some embodiments, the cancer is acute myeloid leukemia (AML), acute lymphoblastic leukemia (ALL), chronic lymphocytic leukemia (CLL), or a B cell lymphoma. In some embodiments, prior to administration of the binding protein, the patient has been treated with daratumumab without a wash-out period.

In some embodiments, the third antigen binding site binds a human HER2 polypeptide, and wherein cancer cells from the individual or patient express HER2. In some embodiments, the cancer is breast cancer, colorectal cancer, gastric cancer, or non-small cell lung cancer (NSCLC).

In some embodiments, provided herein is a method for expanding virus-specific memory T cells, comprising contacting a virus-specific memory T cell with a binding protein, wherein the binding protein comprises four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and $V_{L1}$ form a first antigen binding site that binds a CD28 polypeptide, wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of QSLVHX$_1$NX$_2$X$_3$TY, wherein $X_1$ is E or Q, $X_2$ is A or L, and $X_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65), and wherein $V_{H3}$ and $V_{L3}$ form a third antigen binding site that binds a CD38 polypeptide.

In some embodiments, provided herein is a binding protein that comprises four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and $V_{L1}$ form a first antigen binding site that binds a CD28 polypeptide, wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of QSLVHX$_1$NX$_2$X$_3$TY, wherein $X_1$ is E or Q, $X_2$ is A or L, and $X_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65), and wherein $V_{H3}$ and $V_{L3}$ form a third antigen binding site that binds a CD38 polypeptide for use in expanding virus-specific memory T cells.

In some embodiments, the virus-specific memory T cell is contacted with the binding protein in vitro or ex vivo. In some embodiments, contacting the virus-specific memory T cell with the binding protein causes activation and/or proliferation of virus-specific memory T cells.

In some embodiments, provided herein is a method for expanding T cells, comprising contacting a T cell with a binding protein in vitro or ex vivo, wherein the binding protein comprises four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and $V_{L1}$ form a first antigen binding site that binds a CD28 polypeptide, wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of QSLVHX$_1$NX$_2$X$_3$TY, wherein $X_1$ is E or Q, $X_2$ is A or L, and $X_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65), and wherein $V_{H3}$ and $V_{L3}$ form a third antigen binding site that binds a CD38 polypeptide.

In some embodiments, provided herein is a binding protein that comprises four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and VL form a first antigen binding site that binds a CD28 polypeptide, wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of QSLVHX$_1$NX$_2$X$_3$TY, wherein $X_1$ is E or Q, $X_2$ is A or L, and $X_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65), and wherein $V_{H3}$ and $V_{L3}$ form a third antigen binding site that binds a CD38 polypeptide for use in a method for expanding T cells.

In some embodiments, the T cell is a memory T cell or an effector T cell. In some embodiments, the T cell expresses a chimeric antigen receptor (CAR) on its cell surface or comprises a polynucleotide encoding a CAR.

In some embodiments, provided herein is a method for treating chronic viral infection, comprising administering to an individual or patient in need thereof an effective amount of a binding protein, wherein the binding protein comprises four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and $V_{L1}$ form a first antigen binding site that binds a CD28 polypeptide, wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of QSLVHX$_1$NX$_2$X$_3$TY, wherein $X_1$ is E or Q, $X_2$ is A or L, and $X_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65), and wherein $V_{H3}$ and $V_{L3}$ form a third antigen binding site that binds a CD38 polypeptide.

In some embodiments, provided herein is a binding protein that comprises four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

VL is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and $V_{L1}$ form a first antigen binding site that binds a CD28 polypeptide, wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of QSLVHX$_1$NX$_2$X$_3$TY, wherein $X_1$ is E or Q, $X_2$ is A or L, and $X_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65), and wherein $V_{H3}$ and $V_{L3}$ form a third antigen binding site that binds a CD38 polypeptide for use in a method for treating chronic viral infection, wherein said method comprises administering to an individual or patient in need thereof an effective amount of the binding protein.

In some embodiments, the individual or patient is a human. In some embodiments, the binding protein is administered to the individual or patient in pharmaceutical formulation comprising the binding protein and a pharmaceutically acceptable carrier. In some embodiments, administration of the binding protein results in activation and/or proliferation of virus-specific memory T cells in the individual or patient.

In some embodiments that may be combined with any other embodiments described herein, the memory T cells are CD8+ or CD4+ memory T cells. In some embodiments, the memory T cells are central memory T cells ($T_{CM}$) or effector memory T cells ($T_{EM}$).

In some embodiments that may be combined with any other embodiments described herein, the virus is a human immunodeficiency virus (HIV), influenza virus, cytomegalovirus (CMV), hepatitis B virus (HBV), human papilloma-virus (HPV), Epstein-barr virus (EBV), human foamy virus (HFV), herpes simplex virus 1 (HSV-1), or herpes simplex virus 1 (HSV-2).

In some embodiments that may be combined with any other embodiments described herein, the CD28 polypeptide is a human CD28 polypeptide, wherein the CD3 polypeptide is a human CD3 polypeptide, and wherein the CD38 polypeptide is a human CD38 polypeptide.

In some embodiments, provided herein is a vector system comprising one or more vectors encoding a first, second, third, and fourth polypeptide chain of a binding protein of any one of the above embodiments. In some embodiments, the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein.

In some embodiments, provided herein are kits comprising one, two, three, or four polypeptide chains of a binding protein according to any one of the above embodiments. In some embodiments, the kits further comprise instructions for using the polypeptide chain or binding protein according to any of the methods or uses described herein, e.g., supra.

In some embodiments, provided herein are kits comprising one, two, three, or four polynucleotides according to any one of the above embodiments. In some embodiments, provided herein are kits of polynucleotides comprising one, two, three, or four polynucleotides of a kit of polynucleotides comprising: (a) a first polynucleotide comprising the polynucleotide sequence of SEQ ID NO:189, a second polynucleotide comprising the polynucleotide sequence of SEQ ID NO:190, a third polynucleotide comprising the polynucleotide sequence of SEQ ID NO:191, and a fourth polynucleotide comprising the polynucleotide sequence of SEQ ID NO:192; (b) a first polynucleotide comprising the polynucleotide sequence of SEQ ID NO:193, a second polynucleotide comprising the polynucleotide sequence of SEQ ID NO:194, a third polynucleotide comprising the polynucleotide sequence of SEQ ID NO:195, and a fourth polynucleotide comprising the polynucleotide sequence of SEQ ID NO:196; (c) a first polynucleotide comprising the polynucleotide sequence of SEQ ID NO:197, a second polynucleotide comprising the polynucleotide sequence of SEQ ID NO:198, a third polynucleotide comprising the polynucleotide sequence of SEQ ID NO:199, and a fourth polynucleotide comprising the polynucleotide sequence of SEQ ID NO:200; (d) a first polynucleotide comprising the polynucleotide sequence of SEQ ID NO:201, a second polynucleotide comprising the polynucleotide sequence of SEQ ID NO:202, a third polynucleotide comprising the polynucleotide sequence of SEQ ID NO:203, and a fourth polynucleotide comprising the polynucleotide sequence of SEQ ID NO:204; (e) a first polynucleotide comprising the polynucleotide sequence of SEQ ID NO:205, a second polynucleotide comprising the polynucleotide sequence of SEQ ID NO:206, a third polynucleotide comprising the polynucleotide sequence of SEQ ID NO:207, and a fourth polynucleotide comprising the polynucleotide sequence of SEQ ID NO:208; (f) a first polynucleotide comprising the polynucleotide sequence of SEQ ID NO:209, a second polynucleotide comprising the polynucleotide sequence of SEQ ID NO:210, a third polynucleotide comprising the polynucleotide sequence of SEQ ID NO:211, and a fourth polynucleotide comprising the polynucleotide sequence of SEQ ID NO:212; (g) a first polynucleotide comprising the polynucleotide sequence of SEQ ID NO:213, a second polynucleotide comprising the polynucleotide sequence of SEQ ID NO:214, a third polynucleotide comprising the polynucleotide sequence of SEQ ID NO:215, and a fourth polynucleotide comprising the polynucleotide sequence of SEQ ID NO:216; (h) a first polynucleotide comprising the polynucleotide sequence of SEQ ID NO:217, a second polynucleotide comprising the polynucleotide sequence of SEQ ID NO:218, a third polynucleotide comprising the polynucleotide sequence of SEQ ID NO:219, and a fourth polynucleotide comprising the polynucleotide sequence of SEQ ID NO:220; (i) a first polynucleotide comprising the polynucleotide sequence of SEQ ID NO:221, a second polynucleotide comprising the polynucleotide sequence of SEQ ID NO:222, a third polynucleotide comprising the polynucleotide sequence of SEQ ID NO:223, and a fourth polynucleotide comprising the polynucleotide sequence of SEQ ID NO:224; (j) a first polynucleotide comprising the polynucleotide sequence of SEQ ID NO:225, a second polynucleotide comprising the polynucleotide sequence of SEQ ID NO:226, a third polynucleotide comprising the polynucleotide sequence of SEQ ID NO:227, and a fourth polynucleotide comprising the polynucleotide sequence of SEQ ID NO:228; (k) a first polynucleotide comprising the polynucleotide sequence of SEQ ID NO:229, a second polynucleotide comprising the polynucleotide sequence of SEQ ID NO:230, a third polynucleotide comprising the polynucleotide sequence of SEQ ID NO:231, and a fourth polynucleotide comprising the polynucleotide sequence of SEQ ID NO:232; (l) a first polynucleotide comprising the polynucleotide sequence of SEQ ID NO:233, a second polynucleotide comprising the polynucleotide sequence of SEQ ID NO:234, a third polynucleotide comprising the polynucleotide sequence of SEQ ID NO:235, and a fourth polynucleotide comprising the polynucleotide sequence of SEQ ID NO:236; (m) a first polynucleotide comprising the polynucleotide sequence of SEQ ID NO:237, a second polynucleotide comprising the polynucleotide sequence of SEQ ID NO:238, a third polynucleotide comprising the polynucleotide sequence of SEQ ID NO:239, and a fourth polynucleotide comprising the polynucleotide sequence of SEQ ID NO:240; (n) a first polynucleotide comprising the polynucleotide sequence of SEQ ID NO:241, a second polynucleotide comprising the polynucleotide sequence of SEQ ID NO:242, a third polynucleotide comprising the polynucleotide sequence of SEQ ID NO:243, and a fourth polynucleotide comprising the polynucleotide sequence of SEQ ID NO:244; (o) a first polynucleotide comprising the polynucleotide sequence of SEQ ID NO:245, a second polynucleotide comprising the polynucleotide sequence of SEQ ID NO:246, a third polynucleotide comprising the polynucleotide sequence of SEQ ID NO:247, and a fourth polynucleotide comprising the polynucleotide sequence of SEQ ID NO:248; (p) a first polynucleotide comprising the polynucleotide sequence of SEQ ID NO:249, a second polynucleotide comprising the polynucleotide sequence of SEQ ID NO:250, a third polynucleotide comprising the polynucleotide sequence of SEQ ID NO:251, and a fourth polynucleotide comprising the polynucleotide sequence of SEQ ID NO:252; (q) a first polynucleotide comprising the polynucleotide sequence of SEQ ID NO:253, a second polynucleotide comprising the polynucleotide sequence of SEQ ID NO:254, a third polynucleotide comprising the polynucleotide sequence of SEQ ID NO:255, and a fourth polynucleotide comprising the polynucleotide sequence of SEQ ID NO:256; (r) a first polynucleotide comprising the polynucleotide sequence of SEQ ID NO:257, a second polynucleotide comprising the polynucleotide sequence of SEQ ID NO:258, a third polynucleotide comprising the polynucleotide sequence of SEQ ID NO:259, and a fourth polynucleotide comprising the polynucleotide sequence of SEQ ID NO:260; (s) a first polynucleotide comprising the polynucleotide sequence of SEQ ID NO:261, a second polynucleotide comprising the polynucleotide sequence of SEQ ID NO:262, a third polynucleotide comprising the polynucleotide sequence of SEQ ID NO:263, and a fourth polynucleotide comprising the polynucleotide sequence of SEQ ID NO:264; (t) a first polynucleotide comprising the polynucleotide sequence of SEQ ID NO:265, a second polynucleotide comprising the polynucleotide sequence of SEQ ID NO:266, a third polynucleotide comprising the polynucleotide sequence of SEQ ID NO:267, and a fourth polynucleotide comprising the polynucleotide sequence of SEQ ID NO:268; (u) a first polynucleotide comprising the polynucleotide sequence of SEQ ID NO:269, a second polynucleotide comprising the polynucleotide sequence of SEQ ID NO:270, a third polynucleotide comprising the polynucleotide sequence of SEQ ID NO:271, and a fourth polynucleotide comprising the polynucleotide sequence of SEQ ID NO:272; or (v) a first polynucleotide comprising the polynucleotide sequence of SEQ ID NO:273, a second polynucleotide comprising the polynucleotide sequence of SEQ ID NO:274, a third polynucleotide comprising the polynucleotide sequence of SEQ ID NO:275, and a fourth polynucleotide comprising the polynucleotide sequence of SEQ ID NO:276.

To meet these and other needs, further provided herein are multispecific binding proteins (e.g., antibodies) that form three antigen binding sites, e.g., binding proteins that bind one or more HIV target proteins and a CD3 polypeptide, or an HIV target protein, a CD28 polypeptide, and a CD3 polypeptide. The trispecific anti-HIV/CD28×CD3 T cell engager (TCE) concept disclosed herein is thought to be an effective eliminator of the HIV-1 reservoir through activation by anti-CD3, co-activation by anti-CD28, and subsequent killing of activated HIV-1 reservoir cells through anti-HIV/anti-CD28 by engaging activated CD8 T cells, providing a potential strategy for attacking the HIV-1 reservoir. In addition, anti-CD3 binding sites are described with high affinity binding to human CD3 polypeptides and potential manufacturing liabilities (e.g., deamidation sites) removed.

In some embodiments, provided herein are binding proteins comprising four polypeptide chains that form the three antigen binding sites that specifically bind one or more HIV target proteins, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; wherein $V_{H1}$ and $V_{L1}$ form a first antigen binding site; wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323), and the $V_{L2}$ domain comprises a CDR-L1 sequence comprising the amino acid sequence of QSLVHX$_1$NX$_2$X$_3$TY, wherein X$_1$ is E or Q, X$_2$ is A or L, and X$_3$ is Q, R, or F (SEQ ID NO:594), a CDR-L2 sequence comprising the amino acid sequence of KVS (SEQ ID NO:330), and a CDR-L3 sequence comprising the amino acid sequence of GQGTQYPFT (SEQ ID NO:331); and wherein $V_{H3}$ and $V_{L3}$ form a third antigen binding site that binds an HIV target protein.

In some embodiments, the first binding site binds a CD28 polypeptide (e.g., a human CD28 polypeptide). In some embodiments, the $V_{H1}$ domain comprises a CDR-H1 sequence comprising the amino acid sequence of GYTFTSYY (SEQ ID NO:332), a CDR-H2 sequence comprising the amino acid sequence of IYPGNVNT (SEQ ID NO:333), and a CDR-H3 sequence comprising the amino acid sequence of TRSHYGLDWNFDV (SEQ ID NO:334), and the $V_{L1}$ domain comprises a CDR-L1 sequence comprising the amino acid sequence of QNIYVW (SEQ ID NO:335), a CDR-L2 sequence comprising the amino acid sequence of KAS (SEQ ID NO:336), and a CDR-L3 sequence comprising the amino acid sequence of QQGQTYPY (SEQ ID NO:337). In some embodiments, the $V_{H1}$ domain comprises the amino acid sequence of QVQLVQSGAEVVKPGASVKVSCKASGYTFTSYYIHWVRQAPGQGLEWIGSIYPGN VNTNYAQKFQGRATLTVDTSISTAYMELSRLRSDDTAVYYCTRSHYGLDWNFDV WGKGTTVTVSS (SEQ ID NO:360), and/or the $V_{L1}$ domain comprises the amino acid sequence of DIQMTQSPSSLSASVGDRVTITCQASQNIYVWLNWYQQKPGKAPKLLIYKASNLHT GVPSRFSGSGSGTDFTLTISSLQPEDIATYYCQQGQTYPYTFGQGTKLEIK (SEQ ID NO:361).

In some embodiments, the CDR-L1 sequence of the $V_{L2}$ domain comprises an amino acid sequence selected from the group consisting of QSLVHQNAQTY (SEQ ID NO:325), QSLVHENLQTY (SEQ ID NO:326), QSLVHENLFTY (SEQ ID NO:327), and QSLVHENLRTY (SEQ ID NO:328). In some embodiments, the $V_{H2}$ domain comprises:

an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and the $V_{L2}$ domain comprises a CDR-L1 sequence comprising the amino acid sequence of QSLVHQNAQTY (SEQ ID NO:325), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, the $V_{H2}$ domain comprises: a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and the $V_{L2}$ domain comprises a CDR-L1 sequence comprising the amino acid sequence of QSLVHENLQTY (SEQ ID NO:326), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, the $V_{H2}$ domain comprises: a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and the $V_{L2}$ domain comprises a CDR-L1 sequence comprising the amino acid sequence of QSLVHENLFTY (SEQ ID NO:327), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, the $V_{H2}$ domain comprises: a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and the $V_{L2}$ domain comprises a CDR-L1 sequence comprising the amino acid sequence of QSLVHENLRTY (SEQ ID NO:328), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, the $V_{H2}$ domain comprises the amino acid sequence of QVQLVESGGGVVQPGRSLRLSCAASGFTFTKAWMHWVRQAPGKQLEWVAQIKD KSNSYATYYADSVKGRFTISRDDSKNTLYLQMNSLRAEDTAVYYCRGVYYALSPF DYWGQGTLVTVSS (SEQ ID NO:353), and/or the $V_{L2}$ domain comprises an amino acid sequence selected from the group consisting of DIVMTQTPLSLSVTPGQPASISCKSSQSLVHQNAQTYLSWYLQKPGQSPQSLIYKVS NRFSGVPDRFSGSGSGTDFTLKISRVEAEDVGVYYCGQGTQYPFTFGSGTKVEIK (SEQ ID NO:355), DIVMTQTPLSLSVTPGQPASISCKSSQSLVHENLQTYLSWYLQKPGQSPQSLIYKVS NRFSGVPDRFSGSGSGTDFTLKISRVEAEDVGVYYCGQGTQYPFTFGSGTKVEIK (SEQ ID NO:356), DIVMTQTPLSLSVTPGQPASISCKSSQSLVHENLFTYLSWYLQKPGQSPQSLIYKVS NRFSGVPDRFSGSGSGTDFTLKISRVEAEDVGVYYCGQGTQYPFTFGSGTKVEIK (SEQ ID NO:357), and DIVMTQTPLSLSVTPGQPASISCKSSQSLVHENLRTYLSWYLQKPGQSPQSLIYKVS NRFSGVPDRFSGSGSGTDFTLKISRVEAEDVGVYYCGQGTQYPFTFGSGTKVEIK (SEQ ID NO:358). In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:355. In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:356. In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:357. In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:358.

In some embodiments, the third antigen binding site binds an HIV target protein selected from the group consisting of glycoprotein 120, glycoprotein 41 and glycoprotein 160. In some embodiments, the $V_{H3}$ domain comprises a CDR-H1 sequence comprising the amino acid sequence of NCPIN (SEQ ID NO:302) a CDR-H2 sequence comprising the amino acid sequence of WMKPRHGAVSYARQLQG (SEQ ID NO:303), and a CDR-H3 sequence comprising the amino acid sequence of GKYCTARDYYNWDFEH (SEQ ID NO:304), and the $V_{L3}$ domain comprises a CDR-L1 sequence comprising the amino acid sequence of RTSQYGSLA (SEQ ID NO:305), a CDR-L2 sequence comprising the amino acid sequence of SGSTRAA (SEQ ID NO:306), and a CDR-L3 sequence comprising the amino acid sequence of QQYEF (SEQ ID NO:307). In some embodiments, the $V_{H3}$ domain comprises a CDR-H1 sequence comprising the amino acid sequence of GYTFTAHI (SEQ ID NO:308) a CDR-H2 sequence comprising the amino acid sequence of IKPQYGAV (SEQ ID NO:309) or IKPQYGAT (SEQ ID NO:310), and a CDR-H3 sequence comprising the amino acid sequence of DRSYGDSSWALDA (SEQ ID NO:311), and the $V_{L3}$ domain comprises a CDR-L1 sequence comprising the amino acid sequence of QGVGSD (SEQ ID NO:312), a CDR-L2 sequence comprising the amino acid sequence of HTS (SEQ ID NO:313), and a CDR-L3 sequence comprising the amino acid sequence of CQVLQF (SEQ ID NO:314). In some embodiments, the $V_{H3}$ domain comprises a CDR-H1 sequence comprising the amino acid sequence of DCTLN (SEQ ID NO:315) a CDR-H2 sequence comprising the amino acid sequence of WLKPRWGAVNYARPLQG (SEQ ID NO:316), and a CDR-H3 sequence comprising the amino acid sequence of GKNCDYNWDFEH (SEQ ID NO:317), and the $V_{L3}$ domain comprises a CDR-L1 sequence comprising the amino acid sequence of RTSQYGSLA (SEQ ID NO:318), a CDR-L2 sequence comprising the amino acid sequence of SGSTRAA (SEQ ID NO:319), and a CDR-L3 sequence comprising the amino acid sequence of QQYEF (SEQ ID NO:320). In some embodiments, the $V_{H3}$ domain comprises the amino acid sequence of QVRLSQSGGQMKKPGDSMRISCRASGYEFINCPINWIRLAPGKRPEWMGWMKPRH GAVSYAR- QLQGRVTMTRDMYSETAFLELRSLTSDDTAVYFC-TRGKYCTARDYYN WDFEHWGQGTPVTVSS (SEQ ID NO:344), and/or the $V_{L3}$ domain comprises the amino acid sequence of SLTQSPGTLSLSPGETAIIS-CRTSQYGSLAWYQQRPGQAPRLVIYSGSTRAA-GIPDRF SGSRWGPDYNLTISNLESGDFGVYYCQQY-EFFGQGTKVQVDIK (SEQ ID NO:346). In some embodiments, the $V_{H3}$ domain comprises the amino acid sequence of QVRLSQSGGQMKKPGDSMRISCRASGYE-FINCPINWIRLAPGKRPEWMGWMKPRH GAVSYAR-QLQGRVTMTRQLSQDPDDPDWGTAFLELRSLTSDD-TAVYFCTRGKYC TARDYYNWDFEHWGQGTPVTVSS (SEQ ID NO:345), and/or the $V_{L3}$ domain comprises the amino acid sequence of SLTQSPGTLSLSPGETAIIS-CRTSQYGSLAWYQQRPGQAPRLVIYSGSTRAA-GIPDRF SGSRWGPDYNLTISNLESGDFGVYYCQQY-EFFGQGTKVQVDIK (SEQ ID NO:346). In some embodiments, the $V_{H3}$ domain comprises the amino acid sequence of RAHLVQSGTAMKKP-GASVRVSCQTSGYTFTAHILFWFRQAPGR-GLEWVGWIKPQ YGAVNFGGGFRDRVTLTRDVYRE-IAYMDIRGLKPDDTAVYYCARDRSYGDSSWA LDAWGQGTTVVVSA (SEQ ID NO:347), and/or the $V_{L3}$ domain comprises the amino acid sequence of YIHVTQSPSSLSVSIGDRVTINCQTSQGVGSDLHWY-QHKPGRAPKLLIHHTSSVEDG VPSRFSGSGFHTSFNLTISDLQADDI-ATYYCQVLQFFGRGSRLHIK (SEQ ID NO:350). In some embodiments, the $V_{H3}$ domain comprises the amino acid sequence of RAHLVQSGTAMKKP-GASVRVSCQTSGYTFTAHILFWFRQAPGR-GLEWVGWIKPQ YGATNFGGGFRDRVTLTRDVYRE-IAYMDIRGLKPDDTAVYYCARDRSYGDSSWA LDAWGQGTTVVVSA (SEQ ID NO:348), and/or the $V_{L3}$ domain comprises the amino acid sequence of YIHVTQSPSSLSVSIGDRVTINCQTSQGVGSDLHWY-QHKPGRAPKLLIHHTSSVEDG VPSRFSGSGFHTSFNLTISDLQADDI-ATYYCQVLQFFGRGSRLHIK (SEQ ID NO:350). In some embodiments, the $V_{H3}$ domain comprises the amino acid sequence of RAHLVQSGTAMKKP-GASVRVSCQTSGYTFTAHILFWFRQAPGR-GLEWVGWIKPQ YGAVNFGGGFRDRVTL-TRQLSQDPDDPDWGIAYMDIRGLKPDDTAVYYCARDRS YGDSSWALDAWGQGTTVVVSA (SEQ ID NO:349), and/or the $V_{L3}$ domain comprises the amino acid sequence of YIHVTQSPSSLSVSIGDRVTINCQTSQGVGSDLHWY-QHKPGRAPKLLIHHTSSVEDG VPSRFSGSGFHTSFNLTISDLQADDI-ATYYCQVLQFFGRGSRLHIK (SEQ ID NO:350). In some embodiments, the $V_{H3}$ domain comprises the amino acid sequence of QVQLVQSGGQMKKPGESMRISCRASGYE-FIDCTLNWIRLAPGKRPEWMGWLKPR WGAVNYAR-PLQGRVTMTRQLSQDPDDPDWGTAFLELRSLTVDD-TAVYFCTRGKN CDYNWDFEHWGRGTPVIVSS (SEQ ID NO:351), and/or the $V_{L3}$ domain comprises the amino acid sequence of LTQSPGTLSLSPGETAIIS-CRTSQYGSLAWYQQRPGQAPRLVIYSGSTRAA-GIPDRFS GSRWGPDYNLTISNLESGDFGVYYCQQY-EFFGQGTKVQVDIK (SEQ ID NO:352).

In some embodiments that may be combined with any other embodiments described herein, at least one of $L_1$, $L_2$, $L_3$ or $L_4$ is independently 0 amino acids in length. In some embodiments, $L_1$, $L_2$, $L_3$ and $L_4$ each independently are zero amino acids in length or comprise a sequence selected from the group consisting of GGGGSGGGGS (SEQ ID NO:341), GGGGSGGGGSGGGGS (SEQ ID NO: 342), S, RT, TKGPS (SEQ ID NO: 340), GQPKAAP (SEQ ID NO: 339), and GGSGSSGSGG (SEQ ID NO: 343). In some embodiments, $L_1$, $L_2$, $L_3$ and $L_4$ each independently comprise a sequence selected from the group consisting of GGGGSGGGGS (SEQ ID NO:341), GGGGSGGGGSGGGGS (SEQ ID NO:342), S, RT, TKGPS (SEQ ID NO:340), GQPKAAP (SEQ ID NO: 339), and GGSGSSGSGG (SEQ ID NO:343). In some embodiments, $L_1$ comprises the sequence GQPKAAP (SEQ ID NO: 339), $L_2$ comprises the sequence TKGPS (SEQ ID NO:340), $L_3$ comprises the sequence S, and $L_4$ comprises the sequence RT. In some embodiments, at least one of $L_1$, $L_2$, $L_3$ or $L_4$ comprises the sequence DKTHT (SEQ ID NO:338). In some embodiments, $L_1$, $L_2$, $L_3$ and $L_4$ comprise the sequence DKTHT (SEQ ID NO:338).

In some embodiments that may be combined with any other embodiments described herein, the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 234 and 235 of human IgG4 according to EU Index, wherein the amino acid substitutions are F234A and L235A. In some embodiments, the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 233-236 of human IgG4 according to EU Index, wherein the amino acid substitutions are E233P, F234V, L235A, and a deletion at 236. In some embodiments, the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 228 and 409 of human IgG4 according to EU Index, wherein the amino acid substitutions are S228P and R409K. In some embodiments, the hinge-$C_{H2}$-$C_{H3}$ domains of the second and the third polypeptide chains are human IgG1 hinge-$C_{H2}$-$C_{H3}$ domains, and wherein the hinge-$C_{H2}$-$C_{H3}$ domains each comprise amino acid substitutions at positions corresponding to positions 234, 235, and 329 of human IgG1 according to EU Index, wherein the amino acid substitutions are L234A, L235A, and P329A. In some embodiments, the hinge-$C_{H2}$-$C_{H3}$ domains of the second and the third polypeptide chains are human IgG hinge-$C_{H2}$-$C_{H3}$ domains, and wherein the hinge-$C_{H2}$-$C_{H3}$ domains each comprise amino acid substitutions at positions corresponding to positions 298, 299, and 300 of human IgG1 according to EU Index, wherein the amino acid substitutions are S298N, T299A, and Y300S. In some embodiments, the hinge-$C_{H2}$-$C_{H3}$ domain of the second polypeptide chain comprises amino acid substitutions at positions corresponding to positions 349, 366, 368, and 407 of human IgG1 or IgG4 according to EU Index, wherein the amino acid substitutions are Y349C, T366S, L368A, and Y407V; and wherein the hinge-$C_{H2}$-$C_{H3}$ domain of the third polypeptide chain comprises amino acid substitutions at positions corresponding to positions 354 and 366 of human IgG1 or IgG4 according to EU Index, wherein the amino acid substitutions are S354C and T366W. In some embodiments, the hinge-$C_{H2}$-$C_{H3}$ domain of the second polypeptide chain comprises amino acid substitutions at positions corresponding to positions 354 and 366 of human IgG1 or IgG4 according to EU Index, wherein the amino acid substitutions are S354C and T366W; and wherein the hinge-$C_{H2}$-$C_{H3}$ domain of the third polypeptide chain comprises amino acid substitutions at positions corresponding to positions 349, 366, 368, and 407 of human IgG1 or IgG4 according to EU Index, wherein the amino acid substitutions are Y349C, T366S, L368A, and Y407V.

In some embodiments, the first polypeptide chain comprises the amino acid sequence of SEQ ID NO:362 or an amino acid sequence that is at least 95% identical to the amino acid sequence of SEQ ID NO:362; the second polypeptide chain comprises the amino acid sequence of SEQ ID NO:363 or an amino acid sequence that is at least 95% identical to the amino acid sequence of SEQ ID NO:363; the third polypeptide chain comprises the amino acid sequence of SEQ ID NO:364 or an amino acid sequence that is at least 95% identical to the amino acid sequence of SEQ ID NO:364; and the fourth polypeptide chain comprises the amino acid sequence of SEQ ID NO:365 or an amino acid sequence that is at least 95% identical to the amino acid sequence of SEQ ID NO:365. In some embodiments, the first polypeptide chain comprises the amino acid sequence of SEQ ID NO:366 or an amino acid sequence that is at least 95% identical to the amino acid sequence of SEQ ID NO:366; the second polypeptide chain comprises the amino acid sequence of SEQ ID NO:367 or an amino acid sequence that is at least 95% identical to the amino acid sequence of SEQ ID NO:367; the third polypeptide chain comprises the amino acid sequence of SEQ ID NO:368 or an amino acid sequence that is at least 95% identical to the amino acid sequence of SEQ ID NO:368; and the fourth polypeptide chain comprises the amino acid sequence of SEQ ID NO:369 or an amino acid sequence that is at least 95% identical to the amino acid sequence of SEQ ID NO:369. In some embodiments, the first polypeptide chain comprises the amino acid sequence of SEQ ID NO:370 or an amino acid sequence that is at least 95% identical to the amino acid sequence of SEQ ID NO:370; the second polypeptide chain comprises the amino acid sequence of SEQ ID NO:371 or an amino acid sequence that is at least 95% identical to the amino acid sequence of SEQ ID NO:371; the third polypeptide chain comprises the amino acid sequence of SEQ ID NO:372 or an amino acid sequence that is at least 95% identical to the amino acid sequence of SEQ ID NO:372; and the fourth polypeptide chain comprises the amino acid sequence of SEQ ID NO:373 or an amino acid sequence that is at least 95% identical to the amino acid sequence of SEQ ID NO:373. In some embodiments, the first polypeptide chain comprises the amino acid sequence of SEQ ID NO:374 or an amino acid sequence that is at least 95% identical to the amino acid sequence of SEQ ID NO:374; the second polypeptide chain comprises the amino acid sequence of SEQ ID NO:375 or an amino acid sequence that is at least 95% identical to the amino acid sequence of SEQ ID NO:375; the third polypeptide chain comprises the amino acid sequence of SEQ ID NO:376 or an amino acid sequence that is at least 95% identical to the amino acid sequence of SEQ ID NO:376; and the fourth polypeptide chain comprises the amino acid sequence of SEQ ID NO:377 or an amino acid sequence that is at least 95% identical to the amino acid sequence of SEQ ID NO:377. In some embodiments, the first polypeptide chain comprises the amino acid sequence of SEQ ID NO:378 or an amino acid sequence that is at least 95% identical to the amino acid sequence of SEQ ID NO:378; the second polypeptide chain comprises the amino acid sequence of SEQ ID NO:379 or an amino acid sequence that is at least 95% identical to the amino acid sequence of SEQ ID NO:379; the third polypeptide chain comprises the amino acid sequence of SEQ ID NO:380 or an amino acid sequence that is at least 95% identical to the amino acid sequence of SEQ ID NO:380; and the fourth polypeptide chain comprises the amino acid sequence of SEQ ID NO:381 or an amino acid sequence that is at least 95% identical to the amino acid sequence of SEQ ID NO:381. In some embodiments, the first polypeptide chain comprises the amino acid sequence of SEQ ID NO:382 or an amino acid sequence that is at least 95% identical to the amino acid sequence of SEQ ID NO:382; the second polypeptide chain comprises the amino acid sequence of SEQ ID NO:383 or an amino acid sequence that is at least 95% identical to the amino acid sequence of SEQ ID NO:383; the third polypeptide chain comprises the amino acid sequence of SEQ ID NO:384 or an amino acid sequence that is at least 95% identical to the amino acid sequence of SEQ ID NO:384; and the fourth polypeptide chain comprises the amino acid sequence of SEQ ID NO:385 or an amino acid sequence that is at least 95% identical to the amino acid sequence of SEQ ID NO:385. In some embodiments, the first polypeptide chain comprises the amino acid sequence of SEQ ID NO:386 or an amino acid sequence that is at least 95% identical to the amino acid sequence of SEQ ID NO:386; the second polypeptide chain comprises the amino acid sequence of SEQ ID NO:387 or an amino acid sequence that is at least 95% identical to the amino acid sequence of SEQ ID NO:387; the third polypeptide chain comprises the amino acid sequence of SEQ ID NO:388 or an amino acid sequence that is at least 95% identical to the amino acid sequence of SEQ ID NO:388; and the fourth polypeptide chain comprises the amino acid sequence of SEQ ID NO:389 or an amino acid sequence that is at least 95% identical to the amino acid sequence of SEQ ID NO:389. In some embodiments, the first polypeptide chain comprises the amino acid sequence of SEQ ID NO:390 or an amino acid sequence that is at least 95% identical to the amino acid sequence of SEQ ID NO:390; the second polypeptide chain comprises the amino acid sequence of SEQ ID NO:391 or an amino acid sequence that is at least 95% identical to the amino acid sequence of SEQ ID NO:391; the third polypeptide chain comprises the amino acid sequence of SEQ ID NO:392 or an amino acid sequence that is at least 95% identical to the amino acid sequence of SEQ ID NO:392; and the fourth polypeptide chain comprises the amino acid sequence of SEQ ID NO:393 or an amino acid sequence that is at least 95% identical to the amino acid sequence of SEQ ID NO:393. In some embodiments, the first polypeptide chain comprises the amino acid sequence of SEQ ID NO:394 or an amino acid sequence that is at least 95% identical to the amino acid sequence of SEQ ID NO:394; the second polypeptide chain comprises the amino acid sequence of SEQ ID NO:395 or an amino acid sequence that is at least 95% identical to the amino acid sequence of SEQ ID NO:395; the third polypeptide chain comprises the amino acid sequence of SEQ ID NO:396 or an amino acid sequence that is at least 95% identical to the amino acid sequence of SEQ ID NO:396; and the fourth polypeptide chain comprises the amino acid sequence of SEQ ID NO:397 or an amino acid sequence that is at least 95% identical to the amino acid sequence of SEQ ID NO:397. In some embodiments, the first polypeptide chain comprises the amino acid sequence of SEQ ID NO:398 or an amino acid sequence that is at least 95% identical to the amino acid sequence of SEQ ID NO:398; the second polypeptide chain comprises the amino acid sequence of SEQ ID NO:399 or an amino acid sequence that is at least 95% identical to the amino acid sequence of SEQ ID NO:399; the third polypeptide chain comprises the amino acid sequence of SEQ ID NO:400 or an amino acid sequence that is at least 95% identical to the amino acid sequence of SEQ ID NO:400; and the fourth polypeptide chain comprises the amino acid sequence of SEQ ID NO:401 or an amino acid sequence that is at least 95% identical to the amino acid sequence of SEQ ID NO:401. In some embodiments, the first polypeptide chain comprises the amino acid sequence of SEQ ID NO:402 or an amino acid sequence that is at least 95% identical to the amino acid sequence of SEQ ID NO:402; the second polypeptide chain comprises the amino acid sequence of SEQ ID NO:403 or an amino acid sequence that is at least 95% identical to the amino acid sequence of SEQ ID NO:403; the third polypeptide chain comprises the amino acid sequence of SEQ ID NO:404 or an amino acid sequence that is at least 95% identical to the amino acid sequence of SEQ ID NO:404; and the fourth polypeptide chain comprises the amino acid sequence of SEQ ID NO:405 or an amino acid sequence that is at least 95% identical to the amino acid sequence of SEQ ID NO:405. In some embodiments, the first polypeptide chain comprises the amino acid sequence of SEQ ID NO:406 or an amino acid sequence that is at least 95% identical to the amino acid sequence of SEQ ID NO:406; the second polypeptide chain comprises the amino acid sequence of SEQ ID NO:407 or an amino acid sequence that is at least 95% identical to the amino acid sequence of SEQ ID NO:407; the third polypeptide chain comprises the amino acid sequence of SEQ ID NO:408 or an amino acid sequence that is at least 95% identical to the amino acid sequence of SEQ ID NO:408; and the fourth polypeptide chain comprises the amino acid sequence of SEQ ID NO:409 or an amino acid sequence that is at least 95% identical to the amino acid sequence of SEQ ID NO:409. In some embodiments, the first polypeptide chain comprises the amino acid sequence of SEQ ID NO:410 or an amino acid sequence that is at least 95% identical to the amino acid sequence of SEQ ID NO:410; the second polypeptide chain comprises the amino acid sequence of SEQ ID NO:411 or an amino acid sequence that is at least 95% identical to the amino acid sequence of SEQ ID NO:411; the third polypeptide chain comprises the amino acid sequence of SEQ ID NO:412 or an amino acid sequence that is at least 95% identical to the amino acid sequence of SEQ ID NO:412; and the fourth polypeptide chain comprises the amino acid sequence of SEQ ID NO:413 or an amino acid sequence that is at least 95% identical to the amino acid sequence of SEQ ID NO:413. In some embodiments, the first polypeptide chain comprises the amino acid sequence of SEQ ID NO:414 or an amino acid sequence that is at least 95% identical to the amino acid sequence of SEQ ID NO:414; the second polypeptide chain comprises the amino acid sequence of SEQ ID NO:415 or an amino acid sequence that is at least 95% identical to the amino acid sequence of SEQ ID NO:415; the third polypeptide chain comprises the amino acid sequence of SEQ ID NO:416 or an amino acid sequence that is at least 95% identical to the amino acid sequence of SEQ ID NO:416; and the fourth polypeptide chain comprises the amino acid sequence of SEQ ID NO:417 or an amino acid sequence that is at least 95% identical to the amino acid sequence of SEQ ID NO:417. In some embodiments, the first polypeptide chain comprises the amino acid sequence of SEQ ID NO:418 or an amino acid sequence that is at least 95% identical to the amino acid sequence of SEQ ID NO:418; the second polypeptide chain comprises the amino acid sequence of SEQ ID NO:419 or an amino acid sequence that is at least 95% identical to the amino acid sequence of SEQ ID NO:419; the third polypeptide chain comprises the amino acid sequence of SEQ ID NO:420 or an amino acid sequence that is at least 95% identical to the amino acid sequence of SEQ ID NO:420; and the fourth polypeptide chain comprises the amino acid sequence of SEQ ID NO:421 or an amino acid sequence that is at least 95% identical to the amino acid sequence of SEQ ID NO:421. In some embodiments, the first polypeptide chain comprises the amino acid sequence of SEQ ID NO:422 or an amino acid sequence that is at least 95% identical to the amino acid sequence of SEQ ID NO:422; the second polypeptide chain comprises the amino acid sequence of SEQ ID NO:423 or an amino acid sequence that is at least 95% identical to the amino acid sequence of SEQ ID NO:423; the third polypeptide chain comprises the amino acid sequence of SEQ ID NO:424 or an amino acid sequence that is at least 95% identical to the amino acid sequence of SEQ ID NO:424; and the fourth polypeptide chain comprises the amino acid sequence of SEQ ID NO:425 or an amino acid sequence that is at least 95% identical to the amino acid sequence of SEQ ID NO:425. In some embodiments, the first polypeptide chain comprises the amino acid sequence of SEQ ID NO:430 or an amino acid sequence that is at least 95% identical to the amino acid sequence of SEQ ID NO:430; the second polypeptide chain comprises the amino acid sequence of SEQ ID NO:431 or an amino acid sequence that is at least 95% identical to the amino acid sequence of SEQ ID NO:431; the third polypeptide chain comprises the amino acid sequence of SEQ ID NO:432 or an amino acid sequence that is at least 95% identical to the amino acid sequence of SEQ ID NO:432; and the fourth polypeptide chain comprises the amino acid sequence of SEQ ID NO:433 or an amino acid sequence that is at least 95% identical to the amino acid sequence of SEQ ID NO:433. In some embodiments, the first polypeptide chain comprises the amino acid sequence of SEQ ID NO:434 or an amino acid sequence that is at least 95% identical to the amino acid sequence of SEQ ID NO:434; the second polypeptide chain comprises the amino acid sequence of SEQ ID NO:435 or an amino acid sequence that is at least 95% identical to the amino acid sequence of SEQ ID NO:435; the third polypeptide chain comprises the amino acid sequence of SEQ ID NO:436 or an amino acid sequence that is at least 95% identical to the amino acid sequence of SEQ ID NO:436; and the fourth polypeptide chain comprises the amino acid sequence of SEQ ID NO:437 or an amino acid sequence that is at least 95% identical to the amino acid sequence of SEQ ID NO:437. In some embodiments, the first polypeptide chain comprises the amino acid sequence of SEQ ID NO:438 or an amino acid sequence that is at least 95% identical to the amino acid sequence of SEQ ID NO:438; the second polypeptide chain comprises the amino acid sequence of SEQ ID NO:439 or an amino acid sequence that is at least 95% identical to the amino acid sequence of SEQ ID NO:439; the third polypeptide chain comprises the amino acid sequence of SEQ ID NO:440 or an amino acid sequence that is at least 95% identical to the amino acid sequence of SEQ ID NO:440; and the fourth polypeptide chain comprises the amino acid sequence of SEQ ID NO:441 or an amino acid sequence that is at least 95% identical to the amino acid sequence of SEQ ID NO:441. In some embodiments, the first polypeptide chain comprises the amino acid sequence of SEQ ID NO:442 or an amino acid sequence that is at least 95% identical to the amino acid sequence of SEQ ID NO:442; the second polypeptide chain comprises the amino acid sequence of SEQ ID NO:443 or an amino acid sequence that is at least 95% identical to the amino acid sequence of SEQ ID NO:443; the third polypeptide chain comprises the amino acid sequence of SEQ ID NO:444 or an amino acid sequence that is at least 95% identical to the amino acid sequence of SEQ ID NO:444; and the fourth polypeptide chain comprises the amino acid sequence of SEQ ID NO:445 or an amino acid sequence that is at least 95% identical to the amino acid sequence of SEQ ID NO:445. In some embodiments, the first polypeptide chain comprises the amino acid sequence of SEQ ID NO:446 or an amino acid sequence that is at least 95% identical to the amino acid sequence of SEQ ID NO:446; the second polypeptide chain comprises the amino acid sequence of SEQ ID NO:447 or an amino acid sequence that is at least 95% identical to the amino acid sequence of SEQ ID NO:447; the third polypeptide chain comprises the amino acid sequence of SEQ ID NO:448 or an amino acid sequence that is at least 95% identical to the amino acid sequence of SEQ ID NO:448; and the fourth polypeptide chain comprises the amino acid sequence of SEQ ID NO:449 or an amino acid sequence that is at least 95% identical to the amino acid sequence of SEQ ID NO:449. In some embodiments, the first polypeptide chain comprises the amino acid sequence of SEQ ID NO:450 or an amino acid sequence that is at least 95% identical to the amino acid sequence of SEQ ID NO:450; the second polypeptide chain comprises the amino acid sequence of SEQ ID NO:451 or an amino acid sequence that is at least 95% identical to the amino acid sequence of SEQ ID NO:451; the third polypeptide chain comprises the amino acid sequence of SEQ ID NO:452 or an amino acid sequence that is at least 95% identical to the amino acid sequence of SEQ ID NO:452; and the fourth polypeptide chain comprises the amino acid sequence of SEQ ID NO:453 or an amino acid sequence that is at least 95% identical to the amino acid sequence of SEQ ID NO:453. In some embodiments, the first polypeptide chain comprises the amino acid sequence of SEQ ID NO:454 or an amino acid sequence that is at least 95% identical to the amino acid sequence of SEQ ID NO:454; the second polypeptide chain comprises the amino acid sequence of SEQ ID NO:455 or an amino acid sequence that is at least 95% identical to the amino acid sequence of SEQ ID NO:455; the third polypeptide chain comprises the amino acid sequence of SEQ ID NO:456 or an amino acid sequence that is at least 95% identical to the amino acid sequence of SEQ ID NO:456; and the fourth polypeptide chain comprises the amino acid sequence of SEQ ID NO:457 or an amino acid sequence that is at least 95% identical to the amino acid sequence of SEQ ID NO:457. In some embodiments, the first polypeptide chain comprises the amino acid sequence of SEQ ID NO:458 or an amino acid sequence that is at least 95% identical to the amino acid sequence of SEQ ID NO:458; the second polypeptide chain comprises the amino acid sequence of SEQ ID NO:459 or an amino acid sequence that is at least 95% identical to the amino acid sequence of SEQ ID NO:459; the third polypeptide chain comprises the amino acid sequence of SEQ ID NO:460 or an amino acid sequence that is at least 95% identical to the amino acid sequence of SEQ ID NO:460; and the fourth polypeptide chain comprises the amino acid sequence of SEQ ID NO:461 or an amino acid sequence that is at least 95% identical to the amino acid sequence of SEQ ID NO:461. In some embodiments, the first polypeptide chain comprises the amino acid sequence of SEQ ID NO:462 or an amino acid sequence that is at least 95% identical to the amino acid sequence of SEQ ID NO:462; the second polypeptide chain comprises the amino acid sequence of SEQ ID NO:463 or an amino acid sequence that is at least 95% identical to the amino acid sequence of SEQ ID NO:463; the third polypeptide chain comprises the amino acid sequence of SEQ ID NO:464 or an amino acid sequence that is at least 95% identical to the amino acid sequence of SEQ ID NO:464; and the fourth polypeptide chain comprises the amino acid sequence of SEQ ID NO:465 or an amino acid sequence that is at least 95% identical to the amino acid sequence of SEQ ID NO:465. In some embodiments, the first polypeptide chain comprises the amino acid sequence of SEQ ID NO:466 or an amino acid sequence that is at least 95% identical to the amino acid sequence of SEQ ID NO:466; the second polypeptide chain comprises the amino acid sequence of SEQ ID NO:467 or an amino acid sequence that is at least 95% identical to the amino acid sequence of SEQ ID NO:467; the third polypeptide chain comprises the amino acid sequence of SEQ ID NO:468 or an amino acid sequence that is at least 95% identical to the amino acid sequence of SEQ ID NO:468; and the fourth polypeptide chain comprises the amino acid sequence of SEQ ID NO:469 or an amino acid sequence that is at least 95% identical to the amino acid sequence of SEQ ID NO:469. In some embodiments, the first polypeptide chain comprises the amino acid sequence of SEQ ID NO:470 or an amino acid sequence that is at least 95% identical to the amino acid sequence of SEQ ID NO:470; the second polypeptide chain comprises the amino acid sequence of SEQ ID NO:471 or an amino acid sequence that is at least 95% identical to the amino acid sequence of SEQ ID NO:471; the third polypeptide chain comprises the amino acid sequence of SEQ ID NO:472 or an amino acid sequence that is at least 95% identical to the amino acid sequence of SEQ ID NO:472; and the fourth polypeptide chain comprises the amino acid sequence of SEQ ID NO:473 or an amino acid sequence that is at least 95% identical to the amino acid sequence of SEQ ID NO:473. In some embodiments, the first polypeptide chain comprises the amino acid sequence of SEQ ID NO:474 or an amino acid sequence that is at least 95% identical to the amino acid sequence of SEQ ID NO:474; the second polypeptide chain comprises the amino acid sequence of SEQ ID NO:475 or an amino acid sequence that is at least 95% identical to the amino acid sequence of SEQ ID NO:475; the third polypeptide chain comprises the amino acid sequence of SEQ ID NO:476 or an amino acid sequence that is at least 95% identical to the amino acid sequence of SEQ ID NO:476; and the fourth polypeptide chain comprises the amino acid sequence of SEQ ID NO:477 or an amino acid sequence that is at least 95% identical to the amino acid sequence of SEQ ID NO:477.

In some embodiments, provided herein are isolated nucleic acid molecules comprising a nucleotide sequence encoding the binding protein of any one of the above embodiments. In some embodiments, provided herein are expression vectors comprising the nucleic acid molecule of any one of the above embodiments. In some embodiments, provided herein are isolated host cells comprising the nucleic acid molecule of any one of the above embodiments or the expression vector of any one of the above embodiments. In some embodiments, the host cell is a mammalian or insect cell.

In some embodiments, provided herein are pharmaceutical compositions comprising the binding protein of any one of the above embodiments and a pharmaceutically acceptable carrier.

In some embodiments, provided herein are methods of preventing and/or treating HIV infection in a patient comprising administering to the patient a therapeutically effective amount of at least one binding protein of any one of the above embodiments or the pharmaceutical composition of any one of the above embodiments. In some embodiments, the binding protein is co-administered with standard anti-retroviral therapy. In some embodiments, administration of the at least one binding protein results in the elimination of one or more latently and/or chronically HIV-infected cells in the patient. In some embodiments, the patient is a human.

In some embodiments, the binding protein or pharmaceutical composition of any one of the above embodiments is provided for the prevention and/or treatment of HIV infection in a patient. In some embodiments, the binding protein is to be co-administered with standard anti-retroviral therapy. In some embodiments, the binding protein causes the elimination of one or more latently and/or chronically HIV-infected cells in the patient. In some embodiments, the patient is a human.

In some embodiments, the binding protein or pharmaceutical composition of any one of the above embodiments is provided for use in the manufacture of a medicament for the prevention and/or treatment of HIV infection in a patient. In some embodiments, the binding protein is to be co-administered with standard anti-retroviral therapy. In some embodiments, the binding protein causes the elimination of one or more latently and/or chronically HIV-infected cells in the patient. In some embodiments, the patient is a human.

In some embodiments, provided herein is a vector system comprising one or more vectors encoding a first, second, third, and fourth polypeptide chain of a binding protein of any one of the above embodiments. In some embodiments, the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein.

In some embodiments, provided herein are kits comprising one, two, three, or four polypeptide chains of a binding protein according to any one of the above embodiments. In some embodiments, the kits further comprise instructions for using the polypeptide chain or binding protein according to any of the methods or uses described herein, e.g., supra.

In some embodiments, provided herein are kits comprising one, two, three, or four polynucleotides according to any one of the above embodiments. In some embodiments, provided herein are kits of polynucleotides comprising one, two, three, or four polynucleotides of a kit of polynucleotides comprising: (a) a first polynucleotide comprising the polynucleotide sequence of SEQ ID NO:478, a second polynucleotide comprising the polynucleotide sequence of SEQ ID NO:479, a third polynucleotide comprising the polynucleotide sequence of SEQ ID NO:480, and a fourth polynucleotide comprising the polynucleotide sequence of SEQ ID NO:481; (b) a first polynucleotide comprising the polynucleotide sequence of SEQ ID NO:482, a second polynucleotide comprising the polynucleotide sequence of SEQ ID NO:483, a third polynucleotide comprising the polynucleotide sequence of SEQ ID NO:484, and a fourth polynucleotide comprising the polynucleotide sequence of SEQ ID NO:485; (c) a first polynucleotide comprising the polynucleotide sequence of SEQ ID NO:486, a second polynucleotide comprising the polynucleotide sequence of SEQ ID NO:487, a third polynucleotide comprising the polynucleotide sequence of SEQ ID NO:488, and a fourth polynucleotide comprising the polynucleotide sequence of SEQ ID NO:489; (d) a first polynucleotide comprising the polynucleotide sequence of SEQ ID NO:490, a second polynucleotide comprising the polynucleotide sequence of SEQ ID NO:491, a third polynucleotide comprising the polynucleotide sequence of SEQ ID NO:492, and a fourth polynucleotide comprising the polynucleotide sequence of SEQ ID NO:493; (e) a first polynucleotide comprising the polynucleotide sequence of SEQ ID NO:494, a second polynucleotide comprising the polynucleotide sequence of SEQ ID NO:495, a third polynucleotide comprising the polynucleotide sequence of SEQ ID NO:496, and a fourth polynucleotide comprising the polynucleotide sequence of SEQ ID NO:497; (f) a first polynucleotide comprising the polynucleotide sequence of SEQ ID NO:498, a second polynucleotide comprising the polynucleotide sequence of SEQ ID NO:499, a third polynucleotide comprising the polynucleotide sequence of SEQ ID NO:500, and a fourth polynucleotide comprising the polynucleotide sequence of SEQ ID NO:501; (g) a first polynucleotide comprising the polynucleotide sequence of SEQ ID NO:502, a second polynucleotide comprising the polynucleotide sequence of SEQ ID NO:503, a third polynucleotide comprising the polynucleotide sequence of SEQ ID NO:504, and a fourth polynucleotide comprising the polynucleotide sequence of SEQ ID NO:505; (h) a first polynucleotide comprising the polynucleotide sequence of SEQ ID NO:506, a second polynucleotide comprising the polynucleotide sequence of SEQ ID NO:507, a third polynucleotide comprising the polynucleotide sequence of SEQ ID NO:508, and a fourth polynucleotide comprising the polynucleotide sequence of SEQ ID NO:509; (i) a first polynucleotide comprising the polynucleotide sequence of SEQ ID NO:510, a second polynucleotide comprising the polynucleotide sequence of SEQ ID NO:511, a third polynucleotide comprising the polynucleotide sequence of SEQ ID NO:512, and a fourth polynucleotide comprising the polynucleotide sequence of SEQ ID NO:513; (j) a first polynucleotide comprising the polynucleotide sequence of SEQ ID NO:514, a second polynucleotide comprising the polynucleotide sequence of SEQ ID NO:515, a third polynucleotide comprising the polynucleotide sequence of SEQ ID NO:516, and a fourth polynucleotide comprising the polynucleotide sequence of SEQ ID NO:517; (k) a first polynucleotide comprising the polynucleotide sequence of SEQ ID NO:518, a second polynucleotide comprising the polynucleotide sequence of SEQ ID NO:519, a third polynucleotide comprising the polynucleotide sequence of SEQ ID NO:520, and a fourth polynucleotide comprising the polynucleotide sequence of SEQ ID NO:521; (l) a first polynucleotide comprising the polynucleotide sequence of SEQ ID NO:522, a second polynucleotide comprising the polynucleotide sequence of SEQ ID NO:523, a third polynucleotide comprising the polynucleotide sequence of SEQ ID NO:524, and a fourth polynucleotide comprising the polynucleotide sequence of SEQ ID NO:525; (m) a first polynucleotide comprising the polynucleotide sequence of SEQ ID NO:526, a second polynucleotide comprising the polynucleotide sequence of SEQ ID NO:527, a third polynucleotide comprising the polynucleotide sequence of SEQ ID NO:528, and a fourth polynucleotide comprising the polynucleotide sequence of SEQ ID NO:529; (n) a first polynucleotide comprising the polynucleotide sequence of SEQ ID NO:530, a second polynucleotide comprising the polynucleotide sequence of SEQ ID NO:531, a third polynucleotide comprising the polynucleotide sequence of SEQ ID NO:532, and a fourth polynucleotide comprising the polynucleotide sequence of SEQ ID NO:533; (o) a first polynucleotide comprising the polynucleotide sequence of SEQ ID NO:534, a second polynucleotide comprising the polynucleotide sequence of SEQ ID NO:535, a third polynucleotide comprising the polynucleotide sequence of SEQ ID NO:536, and a fourth polynucleotide comprising the polynucleotide sequence of SEQ ID NO:537; (p) a first polynucleotide comprising the polynucleotide sequence of SEQ ID NO:538, a second polynucleotide comprising the polynucleotide sequence of SEQ ID NO:539, a third polynucleotide comprising the polynucleotide sequence of SEQ ID NO:540, and a fourth polynucleotide comprising the polynucleotide sequence of SEQ ID NO:541; (q) a first polynucleotide comprising the polynucleotide sequence of SEQ ID NO:542, a second polynucleotide comprising the polynucleotide sequence of SEQ ID NO:543, a third polynucleotide comprising the polynucleotide sequence of SEQ ID NO:544, and a fourth polynucleotide comprising the polynucleotide sequence of SEQ ID NO:545; (r) a first polynucleotide comprising the polynucleotide sequence of SEQ ID NO:546, a second polynucleotide comprising the polynucleotide sequence of SEQ ID NO:547, a third polynucleotide comprising the polynucleotide sequence of SEQ ID NO:548, and a fourth polynucleotide comprising the polynucleotide sequence of SEQ ID NO:549; (s) a first polynucleotide comprising the polynucleotide sequence of SEQ ID NO:550, a second polynucleotide comprising the polynucleotide sequence of SEQ ID NO:551, a third polynucleotide comprising the polynucleotide sequence of SEQ ID NO:552, and a fourth polynucleotide comprising the polynucleotide sequence of SEQ ID NO:553; (t) a first polynucleotide comprising the polynucleotide sequence of SEQ ID NO:554, a second polynucleotide comprising the polynucleotide sequence of SEQ ID NO:555, a third polynucleotide comprising the polynucleotide sequence of SEQ ID NO:556, and a fourth polynucleotide comprising the polynucleotide sequence of SEQ ID NO:557; (u) a first polynucleotide comprising the polynucleotide sequence of SEQ ID NO:558, a second polynucleotide comprising the polynucleotide sequence of SEQ ID NO:559, a third polynucleotide comprising the polynucleotide sequence of SEQ ID NO:560, and a fourth polynucleotide comprising the polynucleotide sequence of SEQ ID NO:561; (v) a first polynucleotide comprising the polynucleotide sequence of SEQ ID NO:562, a second polynucleotide comprising the polynucleotide sequence of SEQ ID NO:563, a third polynucleotide comprising the polynucleotide sequence of SEQ ID NO:564, and a fourth polynucleotide comprising the polynucleotide sequence of SEQ ID NO:565; (w) a first polynucleotide comprising the polynucleotide sequence of SEQ ID NO:566, a second polynucleotide comprising the polynucleotide sequence of SEQ ID NO:567, a third polynucleotide comprising the polynucleotide sequence of SEQ ID NO:568, and a fourth polynucleotide comprising the polynucleotide sequence of SEQ ID NO:569; (x) a first polynucleotide comprising the polynucleotide sequence of SEQ ID NO:570, a second polynucleotide comprising the polynucleotide sequence of SEQ ID NO:571, a third polynucleotide comprising the polynucleotide sequence of SEQ ID NO:572, and a fourth polynucleotide comprising the polynucleotide sequence of SEQ ID NO:573; (y) a first polynucleotide comprising the polynucleotide sequence of SEQ ID NO:574, a second polynucleotide comprising the polynucleotide sequence of SEQ ID NO:575, a third polynucleotide comprising the polynucleotide sequence of SEQ ID NO:576, and a fourth polynucleotide comprising the polynucleotide sequence of SEQ ID NO:577; (z) a first polynucleotide comprising the polynucleotide sequence of SEQ ID NO:578, a second polynucleotide comprising the polynucleotide sequence of SEQ ID NO:579, a third polynucleotide comprising the polynucleotide sequence of SEQ ID NO:580, and a fourth polynucleotide comprising the polynucleotide sequence of SEQ ID NO:581; (aa) a first polynucleotide comprising the polynucleotide sequence of SEQ ID NO:582, a second polynucleotide comprising the polynucleotide sequence of SEQ ID NO:583, a third polynucleotide comprising the polynucleotide sequence of SEQ ID NO:584, and a fourth polynucleotide comprising the polynucleotide sequence of SEQ ID NO:585; (bb) a first polynucleotide comprising the polynucleotide sequence of SEQ ID NO:586, a second polynucleotide comprising the polynucleotide sequence of SEQ ID NO:587, a third polynucleotide comprising the polynucleotide sequence of SEQ ID NO:588, and a fourth polynucleotide comprising the polynucleotide sequence of SEQ ID NO:589; or (cc) a first polynucleotide comprising the polynucleotide sequence of SEQ ID NO:590, a second polynucleotide comprising the polynucleotide sequence of SEQ ID NO:591, a third polynucleotide comprising the polynucleotide sequence of SEQ ID NO:592, and a fourth polynucleotide comprising the polynucleotide sequence of SEQ ID NO:593. In some embodiments, the first, second, third, and fourth polynucleotides are present on one or more expression vectors, e.g., one, two, three, or four expression vectors.

It is to be understood that one, some, or all of the properties of the various embodiments described herein may be combined to form other embodiments of the present invention. These and other aspects of the invention will become apparent to one of skill in the art. These and other embodiments of the invention are further described by the detailed description that follows.

BRIEF DESCRIPTION OF THE DRAWINGS

FIGS. 8A-8J show the characterization of in vitro T cell subset expansion in PBMCs collected from EBV-infected Donor C in response to CD38/CD28sup×CD3mid_ENLQ DKTHT IgG4 FALA trispecific antibodies with the indicated alternative anti-CD38 binding domains. A trispecific antibody lacking the CD38VH1 anti-CD38 binding domain was used as a negative control (ΔCD38VH1/ΔCD28sup×ΔCD3mid IgG4 FALA). T cell populations were measured at indicated time points (D3 refers to day 3; D7 refers to day 7). The indicated trispecific antibodies were tested at the indicated concentrations of 0.2 nM and 1 nM. Flow cytometry was used to quantify EBV-specific CD8+ T cells (FIGS. 8A-8B), CMV-specific $T_{cm}$ CD8+ cells (FIGS. 8C-8D), and CMV-specific $T_{em}$ CD8+ cells (FIGS. 8E-8F). In addition, the percentages of EBV-specific $T_{cm}$ (FIGS. 8G-8H) and $T_{em}$ (FIGS. 8I-8J) CD8+ cells were quantified at the indicated time points. All tested trispecific antibodies promoted the proliferation of CMV-specific memory CD8+ T cells with different potency and kinetics in dose response manner.

FIG. 14A shows the analysis of hCD45+, CD8+, CD4+, and mCD45+ cells by flow cytometry. FIG. 14B shows the effect of control or Her2/CD28×CD3 trispecific antibody treatment (at the indicated doses) on hCD45+, CD8+, CD4+, and mCD45+ cell counts. FIG. 14C shows the effect of control or Her2/CD28×CD3 trispecific antibody treatment (at the indicated doses) on human cell ratios (CD4+/CD45+ and CD8+/CD45+). For each x-axis parameter shown in FIGS. 14B & 14C, conditions are (left to right): control, 100 ug/kg trispecific antibody, 10 ug/kg trispecific antibody, 1 ug/kg trispecific antibody, and 0.1 ug/kg trispecific antibody. Percentages shown in FIGS. 14B & 14C are based on control sample vs. 100 ug/kg.

In FIG. 16C, a $ area quantitation approach was used for CD8+ cells instead of cell counting algorithm due to excessive non-specific signal in the CD8 IHC slide.

FIGS. 18A & 18B summarize the mean EC50 (pM) of in vitro cell killing by experimental or control Her2/CD28×CD3 trispecific antibodies against the indicated breast cancer (FIG. 18A) or gastric cancer cell lines (FIG. 18B). Amino acid sequences of the indicated trispecific antibodies are provided in Table 1.

DETAILED DESCRIPTION

Figure 1A:
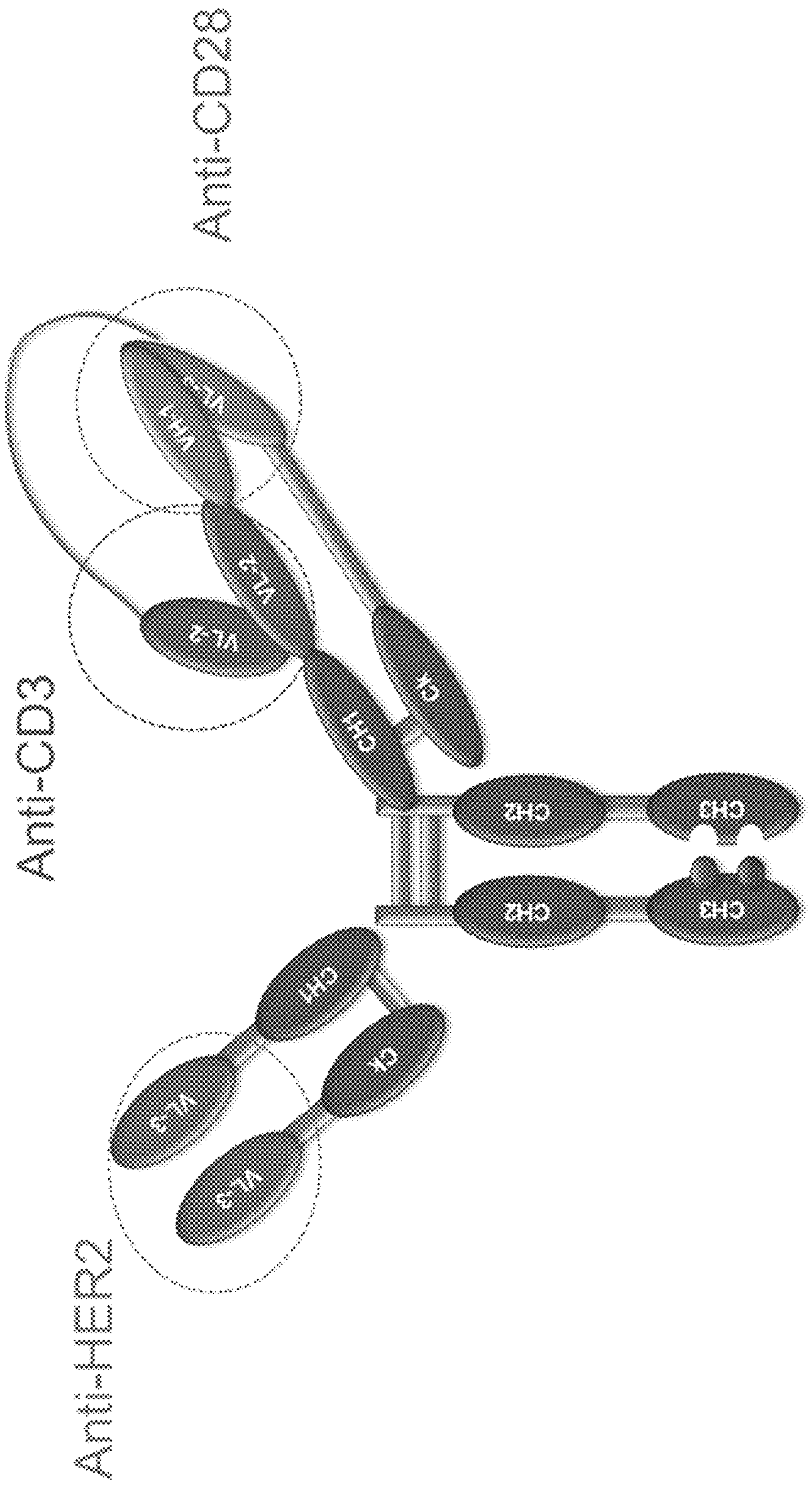
FIG. 1A provides a schematic representation of a trispecific binding protein comprising four polypeptide chains that form three antigen binding sites that binds three target proteins: CD28, CD3, and HER2. A first pair of polypeptides possess dual variable domains having a cross-over orientation (VH1-VH2 and VL2-VL1) forming two antigen binding sites that recognize CD3 and CD28, and a second pair of polypeptides possess a single variable domain (VH3 and VL3) forming a single antigen binding site that recognizes HER2. The trispecific binding protein shown in FIG. 1A uses a constant region with a "knobs-into-holes" mutation, where the knob is on the second pair of polypeptides with a single variable domain.

The disclosure provides trispecific and/or trivalent binding proteins comprising four polypeptide chains that form three antigen binding sites that specifically bind to one or more target proteins, wherein a first pair of polypeptides forming the binding protein possess dual variable domains having a cross-over orientation.

The present disclosure further provides trispecific and/or trivalent binding proteins comprising four polypeptide chains that form three antigen binding sites that specifically bind to one or more human immunodeficiency virus (HIV) target proteins and/or one or more T-cell receptor target proteins, wherein a first pair of polypeptides forming the binding protein possess dual variable domains having a cross-over orientation, and wherein a second pair of polypeptides possess a single variable domain.

I. General Definitions

As utilized in accordance with the present disclosure, the following terms, unless otherwise indicated, shall be understood to have the following meanings. Unless otherwise required by context, singular terms shall include pluralities and plural terms shall include the singular.

It is understood that aspects and embodiments of the disclosure described herein include "comprising," "consisting," and "consisting essentially of" aspects and embodiments.

The term "polynucleotide" as used herein refers to single-stranded or double-stranded nucleic acid polymers of at least 10 nucleotides in length. In certain embodiments, the nucleotides comprising the polynucleotide can be ribonucleotides or deoxyribonucleotides or a modified form of either type of nucleotide. Such modifications include base modifications such as bromuridine, ribose modifications such as arabinoside and 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate. The term "polynucleotide" specifically includes single-stranded and double-stranded forms of DNA.

An "isolated polynucleotide" is a polynucleotide of genomic, cDNA, or synthetic origin or some combination thereof, which: (1) is not associated with all or a portion of a polynucleotide in which the isolated polynucleotide is found in nature, (2) is linked to a polynucleotide to which it is not linked in nature, or (3) does not occur in nature as part of a larger sequence.

An "isolated polypeptide" is one that: (1) is free of at least some other polypeptides with which it would normally be found, (2) is essentially free of other polypeptides from the same source, e.g., from the same species, (3) is expressed by a cell from a different species, (4) has been separated from at least about 50 percent of polynucleotides, lipids, carbohydrates, or other materials with which it is associated in nature, (5) is not associated (by covalent or noncovalent interaction) with portions of a polypeptide with which the "isolated polypeptide" is associated in nature, (6) is operably associated (by covalent or noncovalent interaction) with a polypeptide with which it is not associated in nature, or (7) does not occur in nature. Such an isolated polypeptide can be encoded by genomic DNA, cDNA, mRNA or other RNA, of synthetic origin, or any combination thereof. Preferably, the isolated polypeptide is substantially free from polypeptides or other contaminants that are found in its natural environment that would interfere with its use (therapeutic, diagnostic, prophylactic, research or otherwise).

Naturally occurring antibodies typically comprise a tetramer. Each such tetramer is typically composed of two identical pairs of polypeptide chains, each pair having one full-length "light" chain (typically having a molecular weight of about 25 kDa) and one full-length "heavy" chain (typically having a molecular weight of about 50-70 kDa). The terms "heavy chain" and "light chain" as used herein refer to any immunoglobulin polypeptide having sufficient variable domain sequence to confer specificity for a target antigen. The amino-terminal portion of each light and heavy chain typically includes a variable domain of about 100 to 110 or more amino acids that typically is responsible for antigen recognition. The carboxy-terminal portion of each chain typically defines a constant domain responsible for effector function. Thus, in a naturally occurring antibody, a full-length heavy chain immunoglobulin polypeptide includes a variable domain ($V_H$) and three constant domains ($C_{H1}$, $C_{H2}$, and $C_{H3}$), wherein the $V_H$ domain is at the amino-terminus of the polypeptide and the $C_{H3}$ domain is at the carboxyl-terminus, and a full-length light chain immunoglobulin polypeptide includes a variable domain ($V_L$) and a constant domain ($C_L$), wherein the $V_L$ domain is at the amino-terminus of the polypeptide and the $C_L$ domain is at the carboxyl-terminus.

Human light chains are typically classified as kappa and lambda light chains, and human heavy chains are typically classified as mu, delta, gamma, alpha, or epsilon, and define the antibody's isotype as IgM, IgD, IgG, IgA, and IgE, respectively. IgG has several subclasses, including, but not limited to, IgG1, IgG2, IgG3, and IgG4. IgM has subclasses including, but not limited to, IgM1 and IgM2. IgA is similarly subdivided into subclasses including, but not limited to, IgA1 and IgA2. Within full-length light and heavy chains, the variable and constant domains typically are joined by a "J" region of about 12 or more amino acids, with the heavy chain also including a "D" region of about 10 more amino acids. See, e.g., FUNDAMENTAL IMMUNOLOGY (Paul, W., ed., Raven Press, 2nd ed., 1989), which is incorporated by reference in its entirety for all purposes. The variable regions of each light/heavy chain pair typically form an antigen binding site. The variable domains of naturally occurring antibodies typically exhibit the same general structure of relatively conserved framework regions (FR) joined by three hypervariable regions, also called complementarity determining regions or CDRs. The CDRs from the two chains of each pair typically are aligned by the framework regions, which may enable binding to a specific epitope. From the amino-terminus to the carboxyl-terminus, both light and heavy chain variable domains typically comprise the domains FR1, CDR1, FR2, CDR2, FR3, CDR3, and FR4.

The term "CDR set" refers to a group of three CDRs that occur in a single variable region capable of binding the antigen. The exact boundaries of these CDRs have been defined differently according to different systems. The system described by Kabat (Kabat et al., SEQUENCES OF PROTEINS OF IMMUNOLOGICAL INTEREST (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk, 1987, *J Mol. Biol.* 196: 901-17; Chothia et al., 1989, *Nature* 342: 877-83) found that certain sub-portions within Kabat CDRs adopt nearly identical peptide backbone conformations, despite having great diversity at the level of amino acid sequence. These sub-portions were designated as $L_1$, $L_2$, and $L_3$ or H1, H2, and H3 where the "L" and the "H" designates the light chain and the heavy chain regions, respectively. These regions may be referred to as Chothia CDRs, which have boundaries that overlap with Kabat CDRs. Other boundaries defining CDRs overlapping with the Kabat CDRs have been described by Padlan, 1995, *FASEB J.* 9: 133-39; MacCallum, 1996, *J. Mol. Biol.* 262(5): 732-45; and Lefranc, 2003, *Dev. Comp. Immunol.* 27: 55-77. Still other CDR boundary definitions may not strictly follow one of the herein systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although certain embodiments use Kabat or Chothia defined CDRs. Identification of predicted CDRs using the amino acid sequence is well known in the field, such as in Martin, A. C. "Protein sequence and structure analysis of antibody variable domains," *In Antibody Engineering*, Vol. 2. Kontermann R., Dubel S., eds. Springer-Verlag, Berlin, p. 33-51 (2010). The amino acid sequence of the heavy and/or light chain variable domain may be also inspected to identify the sequences of the CDRs by other conventional methods, e.g., by comparison to known amino acid sequences of other heavy and light chain variable regions to determine the regions of sequence hypervariability. The numbered sequences may be aligned by eye, or by employing an alignment program such as one of the CLUSTAL suite of programs, as described in Thompson, 1994, Nucleic Acids Res. 22: 4673-80. Molecular models are conventionally used to correctly delineate framework and CDR regions and thus correct the sequence-based assignments.

The term "Fc" as used herein refers to a molecule comprising the sequence of a non-antigen-binding fragment resulting from digestion of an antibody or produced by other means, whether in monomeric or multimeric form, and can contain the hinge region. The original immunoglobulin source of the native Fc is preferably of human origin and can be any of the immunoglobulins, although IgG1 and IgG2 are preferred. Fc molecules are made up of monomeric polypeptides that can be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, and IgE) or subclass (e.g., IgG1, IgG2, IgG3, IgA1, and IgGA2). One example of a Fc is a disulfide-bonded dimer resulting from papain digestion of an IgG. The term "native Fc" as used herein is generic to the monomeric, dimeric, and multimeric forms.

A F(ab) fragment typically includes one light chain and the $V_H$ and $C_{H1}$ domains of one heavy chain, wherein the $V_H$-$C_{H1}$ heavy chain portion of the F(ab) fragment cannot form a disulfide bond with another heavy chain polypeptide. As used herein, a F(ab) fragment can also include one light chain containing two variable domains separated by an amino acid linker and one heavy chain containing two variable domains separated by an amino acid linker and a $C_{H1}$ domain.

A F(ab') fragment typically includes one light chain and a portion of one heavy chain that contains more of the constant region (between the $C_{H1}$ and $C_{H2}$ domains), such that an interchain disulfide bond can be formed between two heavy chains to form a F(ab')2 molecule.

The term "binding protein" as used herein refers to a non-naturally occurring (or recombinant or engineered) molecule that specifically binds to at least one target antigen. A trispecific binding protein of the present disclosure, unless otherwise specified, typically comprises four polypeptide chains that form at least three antigen binding sites, wherein a first polypeptide chain has a structure represented by the formula:

$$V_{L2}\text{-}L_1\text{-}V_{L1}\text{-}L_2\text{-}C_L \quad [I]$$

and a second polypeptide chain has a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain has a structure represented by the formula:

$$V_{H3}\text{-}C_{H1} \quad [III]$$

and a fourth polypeptide chain has a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is the immunoglobulin $C_{H1}$ heavy chain constant domain; and hinge is an immunoglobulin hinge region connecting the $C_{H1}$ and $C_{H2}$ domains;

$L_1$, $L_2$, $L_3$ and $L_4$ are amino acid linkers;

nd wherein the polypeptide of formula I and the polypeptide of formula II form a cross-over light chain-heavy chain pair.

A "recombinant" molecule is one that has been prepared, expressed, created, or isolated by recombinant means.

One embodiment of the disclosure provides binding proteins having biological and immunological specificity to between one and three target antigens. Another embodiment of the disclosure provides nucleic acid molecules comprising nucleotide sequences encoding polypeptide chains that form such binding proteins. Another embodiment of the disclosure provides expression vectors comprising nucleic acid molecules comprising nucleotide sequences encoding polypeptide chains that form such binding proteins. Yet another embodiment of the disclosure provides host cells that express such binding proteins (i.e., comprising nucleic acid molecules or vectors encoding polypeptide chains that form such binding proteins).

The term "swapability" as used herein refers to the interchangeability of variable domains within the binding protein format and with retention of folding and ultimate binding affinity. "Full swapability" refers to the ability to swap the order of both $V_{H1}$ and $V_{H2}$ domains, and therefore the order of $V_{L1}$ and $V_{L2}$ domains, in the polypeptide chain of formula I or the polypeptide chain of formula II (i.e., to reverse the order) while maintaining full functionality of the binding protein as evidenced by the retention of binding affinity. Furthermore, it should be noted that the designations $V_H$ and $V_L$ refer only to the domain's location on a particular protein chain in the final format. For example, $V_{H1}$ and $V_{H2}$ could be derived from $V_{L1}$ and $V_{L2}$ domains in parent antibodies and placed into the $V_{H1}$ and $V_{H2}$ positions in the binding protein. Likewise, $V_{L1}$ and $V_{L2}$ could be derived from $V_{H1}$ and $V_{H2}$ domains in parent antibodies and placed in the $V_{H1}$ and $V_{H2}$ positions in the binding protein. Thus, the $V_H$ and $V_L$ designations refer to the present location and not the original location in a parent antibody. $V_H$ and $V_L$ domains are therefore "swappable."

The term "antigen" or "target antigen" or "antigen target" as used herein refers to a molecule or a portion of a molecule that is capable of being bound by a binding protein, and additionally is capable of being used in an animal to produce antibodies capable of binding to an epitope of that antigen. A target antigen may have one or more epitopes. With respect to each target antigen recognized by a binding protein, the binding protein is capable of competing with an intact antibody that recognizes the target antigen.

The term "Her2" refers to human epidermal growth factor receptor 2 which is a member of the epidermal growth factor receptor family.

"CD3" is cluster of differentiation factor 3 polypeptide and is a T-cell surface protein that is typically part of the T cell receptor (TCR) complex.

"CD28" is cluster of differentiation 28 polypeptide and is a T-cell surface protein that provides co-stimulatory signals for T-cell activation and survival.

"CD38" is cluster of differentiation 38 polypeptide and is a glycoprotein found on the surface of many immune cells.

The term "monospecific binding protein" refers to a binding protein that specifically binds to one antigen target.

The term "monovalent binding protein" refers to a binding protein that has one antigen binding site.

The term "bispecific binding protein" refers to a binding protein that specifically binds to two different antigen targets.

The term "bivalent binding protein" refers to a binding protein that has two binding sites.

The term "trispecific binding protein" refers to a binding protein that specifically binds to three different antigen targets.

The term "trivalent binding protein" refers to a binding protein that has three binding sites. In particular embodiments the trivalent binding protein can bind to one antigen target. In other embodiments, the trivalent binding protein can bind to two antigen targets. In other embodiments, the trivalent binding protein can bind to three antigen targets.

An "isolated" binding protein is one that has been identified and separated and/or recovered from a component of its natural environment. Contaminant components of its natural environment are materials that would interfere with diagnostic or therapeutic uses for the binding protein, and may include enzymes, hormones, and other proteinaceous or non-proteinaceous solutes. In some embodiments, the binding protein will be purified: (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated binding proteins include the binding protein in situ within recombinant cells since at least one component of the binding protein's natural environment will not be present.

The terms "substantially pure" or "substantially purified" as used herein refer to a compound or species that is the predominant species present (i.e., on a molar basis it is more abundant than any other individual species in the composition). In some embodiments, a substantially purified fraction is a composition wherein the species comprises at least about 50% (on a molar basis) of all macromolecular species present. In other embodiments, a substantially pure composition will comprise more than about 80%, 85%, 90%, 95%, or 99% of all macromolar species present in the composition. In still other embodiments, the species is purified to essential homogeneity (contaminant species cannot be detected in the composition by conventional detection methods) wherein the composition consists essentially of a single macromolecular species.

The term "epitope" includes any determinant, preferably a polypeptide determinant, capable of specifically binding to an immunoglobulin or T-cell receptor. In certain embodiments, epitope determinants include chemically active surface groupings of molecules such as amino acids, sugar side chains, phosphoryl groups, or sulfonyl groups, and, in certain embodiments, may have specific three-dimensional structural characteristics and/or specific charge characteristics. An epitope is a region of an antigen that is bound by an antibody or binding protein. In certain embodiments, a binding protein is said to specifically bind an antigen when it preferentially recognizes its target antigen in a complex mixture of proteins and/or macromolecules. In some embodiments, a binding protein is said to specifically bind an antigen when the equilibrium dissociation constant is $\leq 10^{-8}$ M, more preferably when the equilibrium dissociation constant is $\leq 10^{-9}$ M, and most preferably when the dissociation constant is $\leq 10^{-10}$ M.

The dissociation constant ($K_D$) of a binding protein can be determined, for example, by surface plasmon resonance. Generally, surface plasmon resonance analysis measures real-time binding interactions between ligand (a target antigen on a biosensor matrix) and analyte (a binding protein in solution) by surface plasmon resonance (SPR) using the BIAcore system (Pharmacia Biosensor; Piscataway, N.J.). Surface plasmon analysis can also be performed by immobilizing the analyte (binding protein on a biosensor matrix) and presenting the ligand (target antigen). The term "$K_D$," as used herein refers to the dissociation constant of the interaction between a particular binding protein and a target antigen.

The term "specifically binds" as used herein refers to the ability of a binding protein or an antigen-binding fragment thereof to bind to an antigen containing an epitope with an Kd of at least about $1\times10^{-6}$ M, $1\times10^{-7}$ M, $1\times10^{-8}$ M, $1\times10^{-9}$ M, $1\times10^{-10}$ M, $1\times10^{-11}$ M, $1\times10^{-12}$ M, or more, and/or to bind to an epitope with an affinity that is at least two-fold greater than its affinity for a nonspecific antigen.

In some embodiments, an antigen binding domain and/or binding protein of the present disclosure "cross reacts" with human and cynomolgus monkey CD38 polypeptides, e.g., CD38 extracellular domains, human CD38 isoform A, human CD38 isoform E, and cynomolgus monkey CD38. A binding protein binding to antigen 1 (Ag1) is "cross-reactive" to antigen 2 (Ag2) when the $EC_{50}$s are in a similar range for both antigens. In the present application, a binding protein binding to Ag1 is cross-reactive to Ag2 when the ratio of affinity of Ag2 to affinity of Ag1 is equal or less than 20, affinities being measured with the same method for both antigens.

The term "linker" as used herein refers to one or more amino acid residues inserted between immunoglobulin domains to provide sufficient mobility for the domains of the light and heavy chains to fold into cross over dual variable region immunoglobulins. A linker is inserted at the transition between variable domains or between variable and constant domains, respectively, at the sequence level. The transition between domains can be identified because the approximate size of the immunoglobulin domains are well understood. The precise location of a domain transition can be determined by locating peptide stretches that do not form secondary structural elements such as beta-sheets or alpha-helices as demonstrated by experimental data or as can be assumed by techniques of modeling or secondary structure prediction. The linkers described herein are referred to as $L_1$, which is located on the light chain between the C-terminus of the $V_{L2}$ and the N-terminus of the VL domain; and $L_2$, which is located on the light chain between the C-terminus of the VL and the N-terminus of the $C_L$ domain. The heavy chain linkers are known as $L_3$, which is located between the C-terminus of the $V_{H1}$ and the N-terminus of the $V_{H2}$ domain; and $L_4$, which is located between the C-terminus of the $V_{H2}$ and the N-terminus of the $C_{H1}$ domain.

The term "vector" as used herein refers to any molecule (e.g., nucleic acid, plasmid, or virus) that is used to transfer coding information to a host cell. The term "vector" includes a nucleic acid molecule that is capable of transporting another nucleic acid to which it has been linked. One type of vector is a "plasmid," which refers to a circular double-stranded DNA molecule into which additional DNA segments may be inserted. Another type of vector is a viral vector, wherein additional DNA segments may be inserted into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell and thereby are replicated along with the host genome. In addition, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. The terms "plasmid" and "vector" may be used interchangeably herein, as a plasmid is the most commonly used form of vector. However, the disclosure is intended to include other forms of expression vectors, such as viral vectors (e.g., replication defective retroviruses, adenoviruses, and adeno-associated viruses), which serve equivalent functions.

The phrase "recombinant host cell" (or "host cell") as used herein refers to a cell into which a recombinant expression vector has been introduced. A recombinant host cell or host cell is intended to refer not only to the particular subject cell, but also to the progeny of such a cell. Because certain modifications may occur in succeeding generations due to either mutation or environmental influences, such progeny may not, in fact, be identical to the parent cell, but such cells are still included within the scope of the term "host cell" as used herein. A wide variety of host cell expression systems can be used to express the binding proteins, including bacterial, yeast, baculoviral, and mammalian expression systems (as well as phage display expression systems). An example of a suitable bacterial expression vector is pUC19. To express a binding protein recombinantly, a host cell is transformed or transfected with one or more recombinant expression vectors carrying DNA fragments encoding the polypeptide chains of the binding protein such that the polypeptide chains are expressed in the host cell and, preferably, secreted into the medium in which the host cells are cultured, from which medium the binding protein can be recovered.

The term "transformation" as used herein refers to a change in a cell's genetic characteristics, and a cell has been transformed when it has been modified to contain a new DNA. For example, a cell is transformed where it is genetically modified from its native state. Following transformation, the transforming DNA may recombine with that of the cell by physically integrating into a chromosome of the cell, or may be maintained transiently as an episomal element without being replicated, or may replicate independently as a plasmid. A cell is considered to have been stably transformed when the DNA is replicated with the division of the cell. The term "transfection" as used herein refers to the uptake of foreign or exogenous DNA by a cell, and a cell has been "transfected" when the exogenous DNA has been introduced inside the cell membrane. A number of transfection techniques are well known in the art. Such techniques can be used to introduce one or more exogenous DNA molecules into suitable host cells.

The term "naturally occurring" as used herein and applied to an object refers to the fact that the object can be found in nature and has not been manipulated by man. For example, a polynucleotide or polypeptide that is present in an organism (including viruses) that can be isolated from a source in nature and that has not been intentionally modified by man is naturally-occurring. Similarly, "non-naturally occurring" as used herein refers to an object that is not found in nature or that has been structurally modified or synthesized by man.

As used herein, the twenty conventional amino acids and their abbreviations follow conventional usage. Stereoisomers (e.g., D-amino acids) of the twenty conventional amino acids; unnatural amino acids and analogs such as α-, α-disubstituted amino acids, N-alkyl amino acids, lactic acid, and other unconventional amino acids may also be suitable components for the polypeptide chains of the binding proteins. Examples of unconventional amino acids include: 4-hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention.

Naturally occurring residues may be divided into classes based on common side chain properties:

(1) hydrophobic: Met, Ala, Val, Leu, Ile, Phe, Trp, Tyr, Pro;

(2) polar hydrophilic: Arg, Asn, Asp, Gln, Glu, His, Lys, Ser, Thr;

(3) aliphatic: Ala, Gly, Ile, Leu, Val, Pro;

(4) aliphatic hydrophobic: Ala, Ile, Leu, Val, Pro;

(5) neutral hydrophilic: Cys, Ser, Thr, Asn, Gln;

(6) acidic: Asp, Glu;

(7) basic: His, Lys, Arg;

(8) residues that influence chain orientation: Gly, Pro;

(9) aromatic: His, Trp, Tyr, Phe; and

(10) aromatic hydrophobic: Phe, Trp, Tyr.

Conservative amino acid substitutions may involve exchange of a member of one of these classes with another member of the same class. Non-conservative substitutions may involve the exchange of a member of one of these classes for a member from another class.

A skilled artisan will be able to determine suitable variants of the polypeptide chains of the binding proteins using well-known techniques. For example, one skilled in the art may identify suitable areas of a polypeptide chain that may be changed without destroying activity by targeting regions not believed to be important for activity. Alternatively, one skilled in the art can identify residues and portions of the molecules that are conserved among similar polypeptides. In addition, even areas that may be important for biological activity or for structure may be subject to conservative amino acid substitutions without destroying the biological activity or without adversely affecting the polypeptide structure.

The term "patient" as used herein includes human and animal subjects.

The terms "pharmaceutical composition" or "therapeutic composition" as used herein refer to a compound or composition capable of inducing a desired therapeutic effect when properly administered to a patient.

The term "pharmaceutically acceptable carrier" or "physiologically acceptable carrier" as used herein refers to one or more formulation materials suitable for accomplishing or enhancing the delivery of a binding protein.

The terms "effective amount" and "therapeutically effective amount" when used in reference to a pharmaceutical composition comprising one or more binding proteins refer to an amount or dosage sufficient to produce a desired therapeutic result. More specifically, a therapeutically effective amount is an amount of a binding protein sufficient to inhibit, for some period of time, one or more of the clinically defined pathological processes associated with the condition being treated. The effective amount may vary depending on the specific binding protein that is being used, and also depends on a variety of factors and conditions related to the patient being treated and the severity of the disorder. For example, if the binding protein is to be administered in vivo, factors such as the age, weight, and health of the patient as well as dose response curves and toxicity data obtained in preclinical animal work would be among those factors considered. The determination of an effective amount or therapeutically effective amount of a given pharmaceutical composition is well within the ability of those skilled in the art.

One embodiment of the disclosure provides a pharmaceutical composition comprising a pharmaceutically acceptable carrier and a therapeutically effective amount of a binding protein.

II. Trispecific and/or Trivalent Binding Proteins for Treating and/or Preventing Cancer Certain aspects of the present disclosure relate to trispecific and/or trivalent binding proteins comprising four polypeptide chains that form three antigen binding sites that specifically bind to one or more target proteins, wherein a first pair of polypeptides forming the binding protein possess dual variable domains having a cross-over orientation and wherein a second pair of polypeptides forming the binding protein possess a single variable domain. Any of the CDRs or variable domains of any of the antigen binding proteins described herein may find use in a trispecific binding protein of the present disclosure.

In some embodiments, each of the three antigen binding sites binds a different target (e.g., polypeptide antigen). In some embodiments, the trispecific binding protein comprises four polypeptide chains that form the three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair.

In some embodiments, e.g., as used in reference to binding proteins of the present disclosure for treating and/or preventing cancer, the term "T-cell engager" refers to binding proteins directed to a host's immune system, more specifically the T cells' cytotoxic activity as well as directed to a tumor target protein.

In some embodiments, e.g., as used in reference to binding proteins of the present disclosure that target cancer, the terms "treatment" or "treat" as used herein refer to both therapeutic treatment and prophylactic or preventative measures. Those in need of treatment include those having a disorder as well as those prone to have the disorder or those in which the disorder is to be prevented. In particular embodiments, binding proteins can be used to treat humans with cancer, or humans susceptible to cancer, or ameliorate cancer in a human subject. The binding proteins can also be used to prevent cancer in a human patient. In particular embodiments, the cancer is multiple myeloma, acute lymphoblastic leukemia, chronic lymphocytic leukemia, acute myeloid leukemia, lymphoma, breast cancer such as Her2+ breast cancer, germinal center B-cell lympohoma or B-cell acute lymphoblastic leukemia, In other embodiments, the binding proteins can be used to treat humans with inflammatory disorders, or humans susceptible to inflammatory disorders, or ameliorate inflammatory disorders in a human subject.

It is contemplated that any of the antigen binding sites described herein may find use in a trispecific binding protein of the present disclosure, e.g., comprising four polypeptide chains having the structures described supra. For example, in some embodiments, a trispecific binding protein of the present disclosure comprises a $V_{H1}$ and $V_{L1}$ domain pair that form a first antigen binding site, a $V_{H2}$ and $V_{L2}$ domain pair that form a second antigen binding site that binds a CD3 polypeptide, and a $V_{H3}$ and $V_{L3}$ domain pair that form a third antigen binding site. In some embodiments, a trispecific binding protein of the present disclosure comprises a $V_{H1}$ and $V_{L1}$ domain pair that form a first antigen binding site that binds a CD28 polypeptide, a $V_{H2}$ and $V_{L2}$ domain pair that form a second antigen binding site that binds a CD3 polypeptide, and a $V_{H3}$ and $V_{L3}$ domain pair that form a third antigen binding site. In some embodiments, a trispecific binding protein of the present disclosure comprises a $V_{H1}$ and $V_{L1}$ domain pair that form a first antigen binding site, a $V_{H2}$ and $V_{L2}$ domain pair that form a second antigen binding site that binds a CD3 polypeptide, and a $V_{H3}$ and $V_{L3}$ domain pair that form a third antigen binding site that binds a tumor target protein. In some embodiments, a trispecific binding protein of the present disclosure comprises a $V_{H1}$ and $V_{L1}$ domain pair that form a first antigen binding site that binds a CD28 polypeptide, a $V_{H2}$ and $V_{L2}$ domain pair that form a second antigen binding site that binds a CD3 polypeptide, and a $V_{H3}$ and $V_{L3}$ domain pair that form a third antigen binding site that binds a tumor target protein. In some embodiments, a trispecific binding protein of the present disclosure comprises a $V_{H1}$ and $V_{L1}$ domain pair that form a first antigen binding site that binds a CD28 polypeptide, a $V_{H2}$ and $V_{L2}$ domain pair that form a second antigen binding site that binds a CD3 polypeptide, and a $V_{H3}$ and $V_{L3}$ domain pair that form a third antigen binding site that binds a CD38 polypeptide. In some embodiments, a trispecific binding protein of the present disclosure comprises a $V_{H1}$ and $V_{L1}$ domain pair that form a first antigen binding site that binds a CD28 polypeptide, a $V_{H2}$ and $V_{L2}$ domain pair that form a second antigen binding site that binds a CD3 polypeptide, and a $V_{H3}$ and $V_{L3}$ domain pair that form a third antigen binding site that binds a HER2 polypeptide.

In some embodiments, a binding protein of the present disclosure binds one or more tumor target proteins and one or more T cell target proteins. In some embodiments, the binding protein is capable of specifically binding one tumor target protein and two different epitopes on a single T cell target protein. In some embodiments, the binding protein is capable of specifically binding one tumor target protein and two different T cell target proteins (e.g., CD28 and CD3). In some embodiments, the first and second polypeptide chains of the binding protein form two antigen binding sites that specifically target two T cell target proteins, and the third and fourth polypeptide chains of the binding protein form an antigen binding site that specifically binds a tumor target protein. In some embodiments, the target protein is CD38 or HER2. Additional tumor target proteins are provided infra. In some embodiments, the one or more T cell target proteins are one or more of CD3 and CD28. Exemplary and non-limiting polypeptides that may find use in any of the trispecific binding proteins described herein are provided in Table 1.

In some embodiments, a binding protein of the present disclosure comprises four polypeptide chains that form three antigen binding sites, wherein the first polypeptide chain comprises the amino acid sequence of SEQ ID NO:156 or an amino acid sequence that is at least 95% identical to the amino acid sequence of SEQ ID NO:156; the second polypeptide chain comprises the amino acid sequence of SEQ ID NO:157 or an amino acid sequence that is at least 95% identical to the amino acid sequence of SEQ ID NO:157; the third polypeptide chain comprises the amino acid sequence of SEQ ID NO:158 or an amino acid sequence that is at least 95% identical to the amino acid sequence of SEQ ID NO:158; and the fourth polypeptide chain comprises the amino acid sequence of SEQ ID NO:159 or an amino acid sequence that is at least 95% identical to the amino acid sequence of SEQ ID NO:159.

In some embodiments, a binding protein of the present disclosure comprises four polypeptide chains that form three antigen binding sites, wherein the first polypeptide chain comprises the amino acid sequence of SEQ ID NO:160 or an amino acid sequence that is at least 95% identical to the amino acid sequence of SEQ ID NO:160; the second polypeptide chain comprises the amino acid sequence of SEQ ID NO:161 or an amino acid sequence that is at least 95% identical to the amino acid sequence of SEQ ID NO:161; the third polypeptide chain comprises the amino acid sequence of SEQ ID NO:162 or an amino acid sequence that is at least 95% identical to the amino acid sequence of SEQ ID NO:162; and the fourth polypeptide chain comprises the amino acid sequence of SEQ ID NO:163 or an amino acid sequence that is at least 95% identical to the amino acid sequence of SEQ ID NO:163.

In some embodiments, a binding protein of the present disclosure comprises four polypeptide chains that form three antigen binding sites, wherein the first polypeptide chain comprises the amino acid sequence of SEQ ID NO:164 or an amino acid sequence that is at least 95% identical to the amino acid sequence of SEQ ID NO:164; the second polypeptide chain comprises the amino acid sequence of SEQ ID NO:165 or an amino acid sequence that is at least 95% identical to the amino acid sequence of SEQ ID NO:165; the third polypeptide chain comprises the amino acid sequence of SEQ ID NO:166 or an amino acid sequence that is at least 95% identical to the amino acid sequence of SEQ ID NO:166; and the fourth polypeptide chain comprises the amino acid sequence of SEQ ID NO:167 or an amino acid sequence that is at least 95% identical to the amino acid sequence of SEQ ID NO:167.

In some embodiments, a binding protein of the present disclosure comprises four polypeptide chains that form three antigen binding sites, wherein the first polypeptide chain comprises the amino acid sequence of SEQ ID NO:168 or an amino acid sequence that is at least 95% identical to the amino acid sequence of SEQ ID NO:168; the second polypeptide chain comprises the amino acid sequence of SEQ ID NO:169 or an amino acid sequence that is at least 95% identical to the amino acid sequence of SEQ ID NO:169; the third polypeptide chain comprises the amino acid sequence of SEQ ID NO:170 or an amino acid sequence that is at least 95% identical to the amino acid sequence of SEQ ID NO:170; and the fourth polypeptide chain comprises the amino acid sequence of SEQ ID NO:171 or an amino acid sequence that is at least 95% identical to the amino acid sequence of SEQ ID NO:171.

In some embodiments, a binding protein of the present disclosure comprises four polypeptide chains that form three antigen binding sites, wherein the first polypeptide chain comprises the amino acid sequence of SEQ ID NO:172 or an amino acid sequence that is at least 95% identical to the amino acid sequence of SEQ ID NO:172; the second polypeptide chain comprises the amino acid sequence of SEQ ID NO:173 or an amino acid sequence that is at least 95% identical to the amino acid sequence of SEQ ID NO:173; the third polypeptide chain comprises the amino acid sequence of SEQ ID NO:174 or an amino acid sequence that is at least 95% identical to the amino acid sequence of SEQ ID NO:174; and the fourth polypeptide chain comprises the amino acid sequence of SEQ ID NO:175 or an amino acid sequence that is at least 95% identical to the amino acid sequence of SEQ ID NO:175.

In some embodiments, a binding protein of the present disclosure comprises four polypeptide chains that form three antigen binding sites, wherein the first polypeptide chain comprises the amino acid sequence of SEQ ID NO:176 or an amino acid sequence that is at least 95% identical to the amino acid sequence of SEQ ID NO:176; the second polypeptide chain comprises the amino acid sequence of SEQ ID NO:177 or an amino acid sequence that is at least 95% identical to the amino acid sequence of SEQ ID NO:177; the third polypeptide chain comprises the amino acid sequence of SEQ ID NO:178 or an amino acid sequence that is at least 95% identical to the amino acid sequence of SEQ ID NO:178; and the fourth polypeptide chain comprises the amino acid sequence of SEQ ID NO:179 or an amino acid sequence that is at least 95% identical to the amino acid sequence of SEQ ID NO:179.

In some embodiments, a binding protein of the present disclosure comprises four polypeptide chains that form three antigen binding sites, wherein the first polypeptide chain comprises the amino acid sequence of SEQ ID NO:181 or an amino acid sequence that is at least 95% identical to the amino acid sequence of SEQ ID NO:181; the second polypeptide chain comprises the amino acid sequence of SEQ ID NO:182 or an amino acid sequence that is at least 95% identical to the amino acid sequence of SEQ ID NO:182; the third polypeptide chain comprises the amino acid sequence of SEQ ID NO:183 or an amino acid sequence that is at least 95% identical to the amino acid sequence of SEQ ID NO:183; and the fourth polypeptide chain comprises the amino acid sequence of SEQ ID NO:184 or an amino acid sequence that is at least 95% identical to the amino acid sequence of SEQ ID NO:184.

In some embodiments, a binding protein of the present disclosure comprises four polypeptide chains that form three antigen binding sites, wherein the first polypeptide chain comprises the amino acid sequence of SEQ ID NO:185 or an amino acid sequence that is at least 95% identical to the amino acid sequence of SEQ ID NO:185; the second polypeptide chain comprises the amino acid sequence of SEQ ID NO:186 or an amino acid sequence that is at least 95% identical to the amino acid sequence of SEQ ID NO:186; the third polypeptide chain comprises the amino acid sequence of SEQ ID NO:187 or an amino acid sequence that is at least 95% identical to the amino acid sequence of SEQ ID NO:187; and the fourth polypeptide chain comprises the amino acid sequence of SEQ ID NO:188 or an amino acid sequence that is at least 95% identical to the amino acid sequence of SEQ ID NO:188.

In some embodiments, a binding protein of the present disclosure comprises four polypeptide chains that form three antigen binding sites, wherein the first polypeptide chain comprises the amino acid sequence of SEQ ID NO:100 or an amino acid sequence that is at least 95% identical to the amino acid sequence of SEQ ID NO:100; the second polypeptide chain comprises the amino acid sequence of SEQ ID NO:101 or an amino acid sequence that is at least 95% identical to the amino acid sequence of SEQ ID NO:101; the third polypeptide chain comprises the amino acid sequence of SEQ ID NO:102 or an amino acid sequence that is at least 95% identical to the amino acid sequence of SEQ ID NO:102; and the fourth polypeptide chain comprises the amino acid sequence of SEQ ID NO:103 or an amino acid sequence that is at least 95% identical to the amino acid sequence of SEQ ID NO:103.

In some embodiments, a binding protein of the present disclosure comprises four polypeptide chains that form three antigen binding sites, wherein the first polypeptide chain comprises the amino acid sequence of SEQ ID NO:104 or an amino acid sequence that is at least 95% identical to the amino acid sequence of SEQ ID NO:104; the second polypeptide chain comprises the amino acid sequence of SEQ ID NO:105 or an amino acid sequence that is at least 95% identical to the amino acid sequence of SEQ ID NO:105; the third polypeptide chain comprises the amino acid sequence of SEQ ID NO:106 or an amino acid sequence that is at least 95% identical to the amino acid sequence of SEQ ID NO:106; and the fourth polypeptide chain comprises the amino acid sequence of SEQ ID NO:107 or an amino acid sequence that is at least 95% identical to the amino acid sequence of SEQ ID NO:107.

In some embodiments, a binding protein of the present disclosure comprises four polypeptide chains that form three antigen binding sites, wherein the first polypeptide chain comprises the amino acid sequence of SEQ ID NO:112 or an amino acid sequence that is at least 95% identical to the amino acid sequence of SEQ ID NO:112; the second polypeptide chain comprises the amino acid sequence of SEQ ID NO:113 or an amino acid sequence that is at least 95% identical to the amino acid sequence of SEQ ID NO:113; the third polypeptide chain comprises the amino acid sequence of SEQ ID NO:114 or an amino acid sequence that is at least 95% identical to the amino acid sequence of SEQ ID NO:114; and the fourth polypeptide chain comprises the amino acid sequence of SEQ ID NO:115 or an amino acid sequence that is at least 95% identical to the amino acid sequence of SEQ ID NO:115.

In some embodiments, a binding protein of the present disclosure comprises four polypeptide chains that form three antigen binding sites, wherein the first polypeptide chain comprises the amino acid sequence of SEQ ID NO:116 or an amino acid sequence that is at least 95% identical to the amino acid sequence of SEQ ID NO:116; the second polypeptide chain comprises the amino acid sequence of SEQ ID NO:117 or an amino acid sequence that is at least 95% identical to the amino acid sequence of SEQ ID NO:117; the third polypeptide chain comprises the amino acid sequence of SEQ ID NO:118 or an amino acid sequence that is at least 95% identical to the amino acid sequence of SEQ ID NO:118; and the fourth polypeptide chain comprises the amino acid sequence of SEQ ID NO:119 or an amino acid sequence that is at least 95% identical to the amino acid sequence of SEQ ID NO:119.

In some embodiments, a binding protein of the present disclosure comprises four polypeptide chains that form three antigen binding sites, wherein the first polypeptide chain comprises the amino acid sequence of SEQ ID NO:120 or an amino acid sequence that is at least 95% identical to the amino acid sequence of SEQ ID NO:120; the second polypeptide chain comprises the amino acid sequence of SEQ ID NO:121 or an amino acid sequence that is at least 95% identical to the amino acid sequence of SEQ ID NO:121; the third polypeptide chain comprises the amino acid sequence of SEQ ID NO:122 or an amino acid sequence that is at least 95% identical to the amino acid sequence of SEQ ID NO:122; and the fourth polypeptide chain comprises the amino acid sequence of SEQ ID NO:123 or an amino acid sequence that is at least 95% identical to the amino acid sequence of SEQ ID NO:123.

In some embodiments, a binding protein of the present disclosure comprises four polypeptide chains that form three antigen binding sites, wherein the first polypeptide chain comprises the amino acid sequence of SEQ ID NO:124 or an amino acid sequence that is at least 95% identical to the amino acid sequence of SEQ ID NO:124; the second polypeptide chain comprises the amino acid sequence of SEQ ID NO:125 or an amino acid sequence that is at least 95% identical to the amino acid sequence of SEQ ID NO:125; the third polypeptide chain comprises the amino acid sequence of SEQ ID NO:126 or an amino acid sequence that is at least 95% identical to the amino acid sequence of SEQ ID NO:126; and the fourth polypeptide chain comprises the amino acid sequence of SEQ ID NO:127 or an amino acid sequence that is at least 95% identical to the amino acid sequence of SEQ ID NO:127.

In some embodiments, a binding protein of the present disclosure comprises four polypeptide chains that form three antigen binding sites, wherein the first polypeptide chain comprises the amino acid sequence of SEQ ID NO:128 or an amino acid sequence that is at least 95% identical to the amino acid sequence of SEQ ID NO:128; the second polypeptide chain comprises the amino acid sequence of SEQ ID NO:129 or an amino acid sequence that is at least 95% identical to the amino acid sequence of SEQ ID NO:129; the third polypeptide chain comprises the amino acid sequence of SEQ ID NO:130 or an amino acid sequence that is at least 95% identical to the amino acid sequence of SEQ ID NO:130; and the fourth polypeptide chain comprises the amino acid sequence of SEQ ID NO:131 or an amino acid sequence that is at least 95% identical to the amino acid sequence of SEQ ID NO:131.

In some embodiments, a binding protein of the present disclosure comprises four polypeptide chains that form three antigen binding sites, wherein the first polypeptide chain comprises the amino acid sequence of SEQ ID NO:132 or an amino acid sequence that is at least 95% identical to the amino acid sequence of SEQ ID NO:132; the second polypeptide chain comprises the amino acid sequence of SEQ ID NO:133 or an amino acid sequence that is at least 95% identical to the amino acid sequence of SEQ ID NO:133; the third polypeptide chain comprises the amino acid sequence of SEQ ID NO:134 or an amino acid sequence that is at least 95% identical to the amino acid sequence of SEQ ID NO:134; and the fourth polypeptide chain comprises the amino acid sequence of SEQ ID NO:135 or an amino acid sequence that is at least 95% identical to the amino acid sequence of SEQ ID NO:135.

In some embodiments, a binding protein of the present disclosure comprises four polypeptide chains that form three antigen binding sites, wherein the first polypeptide chain comprises the amino acid sequence of SEQ ID NO:136 or an amino acid sequence that is at least 95% identical to the amino acid sequence of SEQ ID NO:136; the second polypeptide chain comprises the amino acid sequence of SEQ ID NO:137 or an amino acid sequence that is at least 95% identical to the amino acid sequence of SEQ ID NO:137; the third polypeptide chain comprises the amino acid sequence of SEQ ID NO:138 or an amino acid sequence that is at least 95% identical to the amino acid sequence of SEQ ID NO:138; and the fourth polypeptide chain comprises the amino acid sequence of SEQ ID NO:139 or an amino acid sequence that is at least 95% identical to the amino acid sequence of SEQ ID NO:139.

In some embodiments, a binding protein of the present disclosure comprises four polypeptide chains that form three antigen binding sites, wherein the first polypeptide chain comprises the amino acid sequence of SEQ ID NO:140 or an amino acid sequence that is at least 95% identical to the amino acid sequence of SEQ ID NO:140; the second polypeptide chain comprises the amino acid sequence of SEQ ID NO:141 or an amino acid sequence that is at least 95% identical to the amino acid sequence of SEQ ID NO:141; the third polypeptide chain comprises the amino acid sequence of SEQ ID NO:142 or an amino acid sequence that is at least 95% identical to the amino acid sequence of SEQ ID NO:142; and the fourth polypeptide chain comprises the amino acid sequence of SEQ ID NO:143 or an amino acid sequence that is at least 95% identical to the amino acid sequence of SEQ ID NO:143.

In some embodiments, a binding protein of the present disclosure comprises four polypeptide chains that form three antigen binding sites, wherein the first polypeptide chain comprises the amino acid sequence of SEQ ID NO:144 or an amino acid sequence that is at least 95% identical to the amino acid sequence of SEQ ID NO:144; the second polypeptide chain comprises the amino acid sequence of SEQ ID NO:145 or an amino acid sequence that is at least 95% identical to the amino acid sequence of SEQ ID NO:145; the third polypeptide chain comprises the amino acid sequence of SEQ ID NO:146 or an amino acid sequence that is at least 95% identical to the amino acid sequence of SEQ ID NO:146; and the fourth polypeptide chain comprises the amino acid sequence of SEQ ID NO:147 or an amino acid sequence that is at least 95% identical to the amino acid sequence of SEQ ID NO:147.

In some embodiments, a binding protein of the present disclosure comprises four polypeptide chains that form three antigen binding sites, wherein the first polypeptide chain comprises the amino acid sequence of SEQ ID NO:148 or an amino acid sequence that is at least 95% identical to the amino acid sequence of SEQ ID NO:148; the second polypeptide chain comprises the amino acid sequence of SEQ ID NO:149 or an amino acid sequence that is at least 95% identical to the amino acid sequence of SEQ ID NO:149; the third polypeptide chain comprises the amino acid sequence of SEQ ID NO:150 or an amino acid sequence that is at least 95% identical to the amino acid sequence of SEQ ID NO:150; and the fourth polypeptide chain comprises the amino acid sequence of SEQ ID NO:151 or an amino acid sequence that is at least 95% identical to the amino acid sequence of SEQ ID NO:151.

In some embodiments, a binding protein of the present disclosure comprises four polypeptide chains that form three antigen binding sites, wherein the first polypeptide chain comprises the amino acid sequence of SEQ ID NO:152 or an amino acid sequence that is at least 95% identical to the amino acid sequence of SEQ ID NO:152; the second polypeptide chain comprises the amino acid sequence of SEQ ID NO:153 or an amino acid sequence that is at least 95% identical to the amino acid sequence of SEQ ID NO:153; the third polypeptide chain comprises the amino acid sequence of SEQ ID NO:154 or an amino acid sequence that is at least 95% identical to the amino acid sequence of SEQ ID NO:154; and the fourth polypeptide chain comprises the amino acid sequence of SEQ ID NO:155 or an amino acid sequence that is at least 95% identical to the amino acid sequence of SEQ ID NO:155.

In some embodiments, a binding protein of the present disclosure comprises four polypeptide chains that form three antigen binding sites, wherein the first polypeptide chain comprises the amino acid sequence of SEQ ID NO:286 or an amino acid sequence that is at least 95% identical to the amino acid sequence of SEQ ID NO:286; the second polypeptide chain comprises the amino acid sequence of SEQ ID NO:287 or an amino acid sequence that is at least 95% identical to the amino acid sequence of SEQ ID NO:287; the third polypeptide chain comprises the amino acid sequence of SEQ ID NO:288 or an amino acid sequence that is at least 95% identical to the amino acid sequence of SEQ ID NO:288; and the fourth polypeptide chain comprises the amino acid sequence of SEQ ID NO:289 or an amino acid sequence that is at least 95% identical to the amino acid sequence of SEQ ID NO:289.

In some embodiments, a binding protein of the present disclosure comprises four polypeptide chains that form three antigen binding sites, wherein. the first polypeptide chain comprises the amino acid sequence of SEQ ID NO:290 or an amino acid sequence that is at least 95% identical to the amino acid sequence of SEQ ID NO:290; the second polypeptide chain comprises the amino acid sequence of SEQ ID NO:291 or an amino acid sequence that is at least 95% identical to the amino acid sequence of SEQ ID NO:291; the third polypeptide chain comprises the amino acid sequence of SEQ ID NO:292 or an amino acid sequence that is at least 95% identical to the amino acid sequence of SEQ ID NO:292; and the fourth polypeptide chain comprises the amino acid sequence of SEQ ID NO:293 or an amino acid sequence that is at least 95% identical to the amino acid sequence of SEQ ID NO:293.

In some embodiments, a binding protein of the present disclosure comprises four polypeptide chains that form three antigen binding sites, wherein the first polypeptide chain comprises the amino acid sequence of SEQ ID NO:294 or an amino acid sequence that is at least 95% identical to the amino acid sequence of SEQ ID NO:294; the second polypeptide chain comprises the amino acid sequence of SEQ ID NO:295 or an amino acid sequence that is at least 95% identical to the amino acid sequence of SEQ ID NO:295; the third polypeptide chain comprises the amino acid sequence of SEQ ID NO:296 or an amino acid sequence that is at least 95% identical to the amino acid sequence of SEQ ID NO:296; and the fourth polypeptide chain comprises the amino acid sequence of SEQ ID NO:297 or an amino acid sequence that is at least 95% identical to the amino acid sequence of SEQ ID NO:297.

In some embodiments, a binding protein of the present disclosure comprises four polypeptide chains that form three antigen binding sites, wherein the first polypeptide chain comprises the amino acid sequence of SEQ ID NO:298 or an amino acid sequence that is at least 95% identical to the amino acid sequence of SEQ ID NO:298; the second polypeptide chain comprises the amino acid sequence of SEQ ID NO:299 or an amino acid sequence that is at least 95% identical to the amino acid sequence of SEQ ID NO:299; the third polypeptide chain comprises the amino acid sequence of SEQ ID NO:300 or an amino acid sequence that is at least 95% identical to the amino acid sequence of SEQ ID NO:300; and the fourth polypeptide chain comprises the amino acid sequence of SEQ ID NO:301 or an amino acid sequence that is at least 95% identical to the amino acid sequence of SEQ ID NO:301.

Anti-CD38 Binding Sites

Certain aspects of the present disclosure relate to binding proteins that comprise an antigen binding site that binds a CD38 polypeptide. In some embodiments, the CD38 polypeptide is a human CD38 polypeptide, also known as ADPRC1. Human CD38 polypeptides are known in the art and include, without limitation, the polypeptide represented by NCBI Accession Number NP_001766.2, or a polypeptide produced from NCBI Gene ID Number 952. In some embodiments, the antigen binding site binds a human CD38 polypeptide, a non-human primate (e.g., cynomolgus monkey) CD38 polypeptide, or a human CD38 polypeptide and a non-human primate (e.g., cynomolgus monkey) CD38 polypeptide. In some embodiments, a binding protein comprising an antigen binding site that binds a CD38 polypeptide is monospecific and/or monovalent, bispecific and/or bivalent, trispecific and/or trivalent, or multispecific and/or multivalent.

In some embodiments, any of the CDRs and/or variable domains of the anti-CD38 binding sites described below can be used in a monospecific antibody.

In other embodiments, any of the CDRs and/or variable domains of the anti-CD38 binding sites described below can be used in any binding site of a trispecific binding protein comprising four polypeptides that form three antigen binding sites, e.g., as described supra. In certain embodiments, a binding protein that comprises an antigen binding site that binds a CD38 polypeptide is a trispecific binding protein comprising four polypeptides that form three antigen binding sites as described supra, wherein the $V_{H3}$ and $V_{L3}$ domains pair and form a third antigen binding site that binds a CD38 polypeptide.

A variety of features of exemplary binding sites and binding proteins are described herein. For example, in some embodiments, an anti-CD38 binding site cross-reacts with human CD38 (e.g., a human CD38 isoform A and/or isoform E polypeptide) and cynomolgus monkey CD38. In some embodiments, a binding protein comprising an anti-CD38 binding site induces apoptosis of a CD38+ cell. In some embodiments, a binding protein comprising an anti-CD38 binding site recruits a T cell to a CD38+ cell and optionally activates the T cell (e.g., though TCR stimulation and/or costimulation).

In some embodiments, a binding site that binds CD38 comprises: an antibody heavy chain variable (VH) domain comprising a CDR-H1 sequence comprising the amino acid sequence of GYTFTSYA (SEQ ID NO:13), a CDR-H2 sequence comprising the amino acid sequence of IYPGQGGT (SEQ ID NO:14), and a CDR-H3 sequence comprising the amino acid sequence of ARTGGLRRAYFTY (SEQ ID NO:15); and/or an antibody light chain variable (VL) domain comprising a CDR-L1 sequence comprising the amino acid sequence of QSVSSYGQGF (SEQ ID NO:16), a CDR-L2 sequence comprising the amino acid sequence of GAS (SEQ ID NO:17), and a CDR-L3 sequence comprising the amino acid sequence of QQNKEDPWT (SEQ ID NO:18). In some embodiments, a binding site that binds CD38 comprises: an antibody heavy chain variable (VH) domain comprising a CDR-H1 sequence comprising the amino acid sequence of GYTFTSYA (SEQ ID NO:13), a CDR-H2 sequence comprising the amino acid sequence of IYPGQGGT (SEQ ID NO:14), and a CDR-H3 sequence comprising the amino acid sequence of ARTGGLRRAYFTY (SEQ ID NO:15); and an antibody light chain variable (VL) domain comprising a CDR-L1 sequence comprising the amino acid sequence of QSVSSYGQGF (SEQ ID NO:16), a CDR-L2 sequence comprising the amino acid sequence of GAS (SEQ ID NO:17), and a CDR-L3 sequence comprising the amino acid sequence of QQNKEDPWT (SEQ ID NO:18).

In some embodiments, a binding site that binds CD38 comprises: an antibody heavy chain variable (VH) domain comprising a CDR-H1 sequence comprising the amino acid sequence of GYTLTEFS (SEQ ID NO:19), a CDR-H2 sequence comprising the amino acid sequence of FDPEDGET (SEQ ID NO:20), and a CDR-H3 sequence comprising the amino acid sequence of TTGRFFDWF (SEQ ID NO:21); and/or an antibody light chain variable (VL) domain comprising a CDR-L1 sequence comprising the amino acid sequence of QSVISRF (SEQ ID NO:22), a CDR-L2 sequence comprising the amino acid sequence of GAS (SEQ ID NO:23), and a CDR-L3 sequence comprising the amino acid sequence of QQDSNLPIT (SEQ ID NO:24). In some embodiments, a binding site that binds CD38 comprises: an antibody heavy chain variable (VH) domain comprising a CDR-H1 sequence comprising the amino acid sequence of GYTLTEFS (SEQ ID NO:19), a CDR-H2 sequence comprising the amino acid sequence of FDPEDGET (SEQ ID NO:20), and a CDR-H3 sequence comprising the amino acid sequence of TTGRFFDWF (SEQ ID NO:21); and an antibody light chain variable (VL) domain comprising a CDR-L1 sequence comprising the amino acid sequence of QSVISRF (SEQ ID NO:22), a CDR-L2 sequence comprising the amino acid sequence of GAS (SEQ ID NO:23), and a CDR-L3 sequence comprising the amino acid sequence of QQDSNLPIT (SEQ ID NO:24).

In some embodiments, a binding site that binds CD38 comprises: an antibody heavy chain variable (VH) domain comprising a CDR-H1 sequence comprising the amino acid sequence of GYAFTTYL (SEQ ID NO:25), a CDR-H2 sequence comprising the amino acid sequence of INPGSGST (SEQ ID NO:26), and a CDR-H3 sequence comprising the amino acid sequence of ARYAYGY (SEQ ID NO:27); and/or an antibody light chain variable (VL) domain comprising a CDR-L1 sequence comprising the amino acid sequence of QNVGTA (SEQ ID NO:28), a CDR-L2 sequence comprising the amino acid sequence of SAS (SEQ ID NO:29), and a CDR-L3 sequence comprising the amino acid sequence of QQYSTYPFT (SEQ ID NO:30). In some embodiments, a binding site that binds CD38 comprises: an antibody heavy chain variable (VH) domain comprising a CDR-H1 sequence comprising the amino acid sequence of GYAFTTYL (SEQ ID NO:25), a CDR-H2 sequence comprising the amino acid sequence of INPGSGST (SEQ ID NO:26), and a CDR-H3 sequence comprising the amino acid sequence of ARYAYGY (SEQ ID NO:27); and an antibody light chain variable (VL) domain comprising a CDR-L1 sequence comprising the amino acid sequence of QNVGTA (SEQ ID NO:28), a CDR-L2 sequence comprising the amino acid sequence of SAS (SEQ ID NO:29), and a CDR-L3 sequence comprising the amino acid sequence of QQYSTYPFT (SEQ ID NO:30).

In some embodiments, a binding site that binds CD38 comprises: an antibody heavy chain variable (VH) domain comprising a CDR-H1 sequence comprising the amino acid sequence of GYSFTNYA (SEQ ID NO:31), a CDR-H2 sequence comprising the amino acid sequence of ISPYYGDT (SEQ ID NO:32), and a CDR-H3 sequence comprising the amino acid sequence of ARRFEGFYYSMDY (SEQ ID NO:33); and/or an antibody light chain variable (VL) domain comprising a CDR-L1 sequence comprising the amino acid sequence of QSLVHSNGNTY (SEQ ID NO:34), a CDR-L2 sequence comprising the amino acid sequence of KVS (SEQ ID NO:35), and a CDR-L3 sequence comprising the amino acid sequence of SQSTHVPLT (SEQ ID NO:36). In some embodiments, a binding site that binds CD38 comprises: an antibody heavy chain variable (VH) domain comprising a CDR-H1 sequence comprising the amino acid sequence of GYSFTNYA (SEQ ID NO:31), a CDR-H2 sequence comprising the amino acid sequence of ISPYYGDT (SEQ ID NO:32), and a CDR-H3 sequence comprising the amino acid sequence of ARRFEGFYYSMDY (SEQ ID NO:33); and an antibody light chain variable (VL) domain comprising a CDR-L1 sequence comprising the amino acid sequence of QSLVHSNGNTY (SEQ ID NO:34), a CDR-L2 sequence comprising the amino acid sequence of KVS (SEQ ID NO:35), and a CDR-L3 sequence comprising the amino acid sequence of SQSTHVPLT (SEQ ID NO:36).

In some embodiments, a binding site that binds CD38 comprises: an antibody heavy chain variable (VH) domain comprising a CDR-H1 sequence comprising the amino acid sequence of GFTFSSYG (SEQ ID NO:37), a CDR-H2 sequence comprising the amino acid sequence of IWYDGSNK (SEQ ID NO:38), and a CDR-H3 sequence comprising the amino acid sequence of ARDPGLRYFDGGMDV (SEQ ID NO:39); and/or an antibody light chain variable (VL) domain comprising a CDR-L1 sequence comprising the amino acid sequence of QGISSY (SEQ ID NO:40), a CDR-L2 sequence comprising the amino acid sequence of AAS (SEQ ID NO:41), and a CDR-L3 sequence comprising the amino acid sequence of QQLNSFPYT (SEQ ID NO:42). In some embodiments, a binding site that binds CD38 comprises: an antibody heavy chain variable (VH) domain comprising a CDR-H1 sequence comprising the amino acid sequence of GFTFSSYG (SEQ ID NO:37), a CDR-H2 sequence comprising the amino acid sequence of IWYDGSNK (SEQ ID NO:38), and a CDR-H3 sequence comprising the amino acid sequence of ARDPGLRYFDGGMDV (SEQ ID NO:39); and an antibody light chain variable (VL) domain comprising a CDR-L1 sequence comprising the amino acid sequence of QGISSY (SEQ ID NO:40), a CDR-L2 sequence comprising the amino acid sequence of AAS (SEQ ID NO:41), and a CDR-L3 sequence comprising the amino acid sequence of QQLNSFPYT (SEQ ID NO:42).

In some embodiments, a binding site that binds CD38 comprises: an antibody heavy chain variable (VH) domain comprising a CDR-H1 sequence comprising the amino acid sequence of GFTFSSYG (SEQ ID NO:43), a CDR-H2 sequence comprising the amino acid sequence of IWYDGSNK (SEQ ID NO:44), and a CDR-H3 sequence comprising the amino acid sequence of ARMFRGAFDY (SEQ ID NO:45); and/or an antibody light chain variable (VL) domain comprising a CDR-L1 sequence comprising the amino acid sequence of QGIRND (SEQ ID NO:46), a CDR-L2 sequence comprising the amino acid sequence of AAS (SEQ ID NO:47), and a CDR-L3 sequence comprising the amino acid sequence of LQDYIYYPT (SEQ ID NO:48). In some embodiments, a binding site that binds CD38 comprises: an antibody heavy chain variable (VH) domain comprising a CDR-H1 sequence comprising the amino acid sequence of GFTFSSYG (SEQ ID NO:43), a CDR-H2 sequence comprising the amino acid sequence of IWYDGSNK (SEQ ID NO:44), and a CDR-H3 sequence comprising the amino acid sequence of ARMFRGAFDY (SEQ ID NO:45); and an antibody light chain variable (VL) domain comprising a CDR-L1 sequence comprising the amino acid sequence of QGIRND (SEQ ID NO:46), a CDR-L2 sequence comprising the amino acid sequence of AAS (SEQ ID NO:47), and a CDR-L3 sequence comprising the amino acid sequence of LQDYIYYPT (SEQ ID NO:48).

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVQSGAEVVKPGASVKVSCKASGYTFTSYAMHWVKEAPGQRLEWIGYIYPGQ GGTNYNQKFQGRATLTADTSASTAYMELSSLRSEDTAVYFCARTGGLRRAYFTYWG QGTLVTVSS (SEQ ID NO:79), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVLTQSPATLSLSPGERATISCRASQSVSSYGQGFMHWYQQKPGQPPRLLIYGASSR ATGIPARFSGSGSGTDFTLTISPLEPEDFAVYYCQQNKEDPWTFGGGTKLEIK (SEQ ID NO:80). In some embodiments, a binding site that binds CD38 comprises: an antibody heavy chain variable (VH) domain comprising the amino acid sequence of SEQ ID NO:79, and/or an antibody light chain variable (VL) domain comprising the amino acid sequence of SEQ ID NO:80. In some embodiments, a binding site that binds CD38 comprises: an antibody heavy chain variable (VH) domain comprising the amino acid sequence of SEQ ID NO:79, and an antibody light chain variable (VL) domain comprising the amino acid sequence of SEQ ID NO:80.

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVQSGAEVKKPGASVKVSCKVSGYTLTEFSIHWVRQAPGQGLEWMGGFDPED GETIYAQKFQGRVIMTEDTSTDTAYMEMNSLRSEDTAIYYCTTGRFFDWFWGQGTL VTVSS (SEQ ID NO:81), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EIILTQSPAILSLSPGERATLSCRASQSVISRFLSWYQVKPGLAPRLLIYGASTRATGIPV RFSGSGSGTDFSLTISSLQPEDCAVYYCQQDSNLPITFGQGTRLEIK (SEQ ID NO:82). In some embodiments, a binding site that binds CD38 comprises: an antibody heavy chain variable (VH) domain comprising the amino acid sequence of SEQ ID NO:81, and/or an antibody light chain variable (VL) domain comprising the amino acid sequence of SEQ ID NO:82. In some embodiments, a binding site that binds CD38 comprises: an antibody heavy chain variable (VH) domain comprising the amino acid sequence of SEQ ID NO:81, and an antibody light chain variable (VL) domain comprising the amino acid sequence of SEQ ID NO:82.

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVQSGAEVKKPGASVKVSCKASGYAFTTYL- VEWIRQRPGQGLEWMGVINPGS GSTNYAQKFQGRVTMTVDRSSTTAYMELSRLRSDD-TAVYYCARYAYGYWGQGTL VTVSS (SEQ ID NO:83), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQNVGTA-VAWYQQKPGKSPKQLIYSASNRYTG VPSRFSGSGSGTDFTLTISSLQPED-LATYYCQQYSTYPFTFGQGTKLEIK (SEQ ID NO:84). In some embodiments, a binding site that binds CD38 comprises: an antibody heavy chain variable (VH) domain comprising the amino acid sequence of SEQ ID NO:83, and/or an antibody light chain variable (VL) domain comprising the amino acid sequence of SEQ ID NO:84. In some embodiments, a binding site that binds CD38 comprises: an antibody heavy chain variable (VH) domain comprising the amino acid sequence of SEQ ID NO:83, and an antibody light chain variable (VL) domain comprising the amino acid sequence of SEQ ID NO:84.

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLSCAASGFTFSSYG-MYWVRQAPGKGLEWVAVIWYDG SNKYY-ADSVKGRFTISRDNSKNTLYLQMNSLRAEDTAVYH-CARDPGLRYFDGGMD VWGQGTTVTVSS (SEQ ID NO:87), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQLTQSPSFLSASVGDRVTITCRASQGISSY-LAWYQQKPGKAPKLLIFAASTLHSGVP SRFSGSGSGTEFTLTISSLQPEDFATYYCQQLNSFPY-TFGQGTKLEIK (SEQ ID NO:88). In some embodiments, a binding site that binds CD38 comprises: an antibody heavy chain variable (VH) domain comprising the amino acid sequence of SEQ ID NO:87, and/or an antibody light chain variable (VL) domain comprising the amino acid sequence of SEQ ID NO:88. In some embodiments, a binding site that binds CD38 comprises: an antibody heavy chain variable (VH) domain comprising the amino acid sequence of SEQ ID NO:87, and an antibody light chain variable (VL) domain comprising the amino acid sequence of SEQ ID NO:88.

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLS-CAASGFTFSSYGMHWVRQAPGKGLEWVAVIWYDG SNKYYADSVKGRFTISGDNSKNTLYLQMNSLRAED-TAVYYCARMFRGAFDYWGQG TLVTVSS (SEQ ID NO:89), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of AIQMTQSPSSLSASVGDRVTITCRASQ-GIRNDLGWYQQKPGKAPKLLIYAASSLQSG VPSRFSGSGSGTDFTLTISGLQPEDSATYY-CLQDYIYYPTFGQGTKVEIK (SEQ ID NO:90). In some embodiments, a binding site that binds CD38 comprises: an antibody heavy chain variable (VH) domain comprising the amino acid sequence of SEQ ID NO:89, and/or an antibody light chain variable (VL) domain comprising the amino acid sequence of SEQ ID NO:90. In some embodiments, a binding site that binds CD38 comprises: an antibody heavy chain variable (VH) domain comprising the amino acid sequence of SEQ ID NO:89, and an antibody light chain variable (VL) domain comprising the amino acid sequence of SEQ ID NO:90.

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVQSGAEVKKPGASVKVSCK-ASGYSFTNYAVHWVRQAPGQGLEWMGVISPY YGDT-TYAQKFQGRVTMTVDKSSSTAYMELSRLRSDD-TAVYYCARRFEGFYYSMDY WGQGTLVTVSS (SEQ ID NO:85), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DVVMTQSPLSLPVTLGQPASISCRPSQSLVHSNGN-TYLNWYQQRPGQSPKLLIYKVS KRFSGVPDRFSGSGSGTDFTLKISRVEAE-DVGVYYCSQSTHVPLTFGGGTKVEIK (SEQ ID NO:86). In some embodiments, a binding site that binds CD38 comprises: an antibody heavy chain variable (VH) domain comprising the amino acid sequence of SEQ ID NO:85, and/or an antibody light chain variable (VL) domain comprising the amino acid sequence of SEQ ID NO:86. In some embodiments, a binding site that binds CD38 comprises: an antibody heavy chain variable (VH) domain comprising the amino acid sequence of SEQ ID NO:85, and an antibody light chain variable (VL) domain comprising the amino acid sequence of SEQ ID NO:86.

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLQQSGPELVRPGTSVKVSCKASGYAFTTYL-VEWIKQRPGQGLEWIGVINPGSGS TNYNEKFKGKATLTVDRSSTTAYMHLSGLTSDD-SAVYFCARYAYGYWGQGTTLTV SS (SEQ ID NO:277), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQSQKFMSASVGDRVSITCKASQNVGTA- VAWYQQQPGHSPKQLIYSASNRYT GVPDRFTGSGAGTDFTLTISNIQSEDLA-DYFCQQYSTYPFTFGSGTKLEIK (SEQ ID NO:278). In some embodiments, a binding site that binds CD38 comprises: an antibody heavy chain variable (VH) domain comprising the amino acid sequence of SEQ ID NO:277, and/or an antibody light chain variable (VL) domain comprising the amino acid sequence of SEQ ID NO:278. In some embodiments, a binding site that binds CD38 comprises: an antibody heavy chain variable (VH) domain comprising the amino acid sequence of SEQ ID NO:277, and an antibody light chain variable (VL) domain comprising the amino acid sequence of SEQ ID NO:278. In some embodiments, the VH and/or VL domains are humanized.

In some embodiments, a binding site that binds CD38 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLLQSGAELVRPGVSVKIS-CTGSGYSFTNYAVHWVKQSHVKSLEWIGVISPYYGD TTYNQKFTGKATMTVDKSSSTAYMELARLTSED-SAIYFCARRFEGFYYSMDYWGQG TSVTVSS (SEQ ID NO:279), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DVVMIQTPLSLPVSLGDQASISCRPSQSLVHSNGN-TYLNWYLQRPGQSPKLLIYKVSK RFSGVPDRFSGSGSGTDFTLKISRVEAEDLGVYL-CSQSTHVPLTFGSGTQLEIK (SEQ ID NO:280). In some embodiments, a binding site that binds CD38 comprises: an antibody heavy chain variable (VH) domain comprising the amino acid sequence of SEQ ID NO:279, and/or an antibody light chain variable (VL) domain comprising the amino acid sequence of SEQ ID NO:280. In some embodiments, a binding site that binds CD38 comprises: an antibody heavy chain variable (VH) domain comprising the amino acid sequence of SEQ ID NO:279, and an antibody light chain variable (VL) domain comprising the amino acid sequence of SEQ ID NO:280. In some embodiments, the VH and/or VL domains are humanized.

In some embodiments of any of the above embodiments, the binding protein is a trispecific binding protein. In some embodiments, the trispecific binding protein comprising an antigen binding site that binds a CD38 polypeptide, an antigen binding site that binds a CD28 polypeptide, and an antigen binding site that binds a CD3 polypeptide. In some embodiments, the binding protein is a trispecific binding protein comprising four polypeptides comprising three antigen binding sites, wherein the polypeptide of formula I and the polypeptide of formula II form a cross-over light chain-heavy chain pair (e.g., as described herein). In some embodiments, the VH and VL domains of any of the anti-CD38 antigen binding sites described above represent $V_{H3}$ and $V_{L3}$ and form a third antigen binding site that binds a CD38 polypeptide. In some embodiments, $V_{H1}$ and $V_{L1}$ form a first antigen binding site that binds a CD28 polypeptide, $V_{H2}$ and $V_{L2}$ form a second antigen binding site that binds a CD3 polypeptide, and the VH and VL domains of any of the anti-CD38 antigen binding sites described above and/or in Table 2 represent $V_{H3}$ and $V_{L3}$ and form a third antigen binding site that binds a CD38 polypeptide.

Sequences of exemplary anti-CD38 antigen binding sites are provided in Table 2. In some embodiments, a binding protein comprising an anti-CD38 antigen binding site of the present disclosure comprises 1, 2, 3, 4, 5, or all 6 CDR sequences of an anti-CD38 antibody described in Table 2. In some embodiments, a binding protein comprising an anti-CD38 antigen binding site of the present disclosure comprises a VH domain sequence and/or VL domain sequence of an anti-CD38 antibody described in Table 2.

TABLE 2

Anti-CD38 binding protein sequences.

| Sequence Type | Molecule | Description | SEQ ID NO | Sequence |
|---|---|---|---|---|
| CDR | Anti-CD38 (VH1) | CDR-H1 | 13 | GYTFTSYA |
| | | CDR-H2 | 14 | IYPGQGGT |
| | | CDR-H3 | 15 | ARTGGLRRAYFTY |
| | | CDR-L1 | 16 | QSVSSYGQGF |
| | | CDR-L2 | 17 | GAS |
| | | CDR-L3 | 18 | QQNKEDPWT |
| | Anti-CD38 (hhy992) | CDR-H1 | 19 | GYTLTEFS |
| | | CDR-H2 | 20 | FDPEDGET |
| | | CDR-H3 | 21 | TTGRFFDWF |
| | | CDR-L1 | 22 | QSVISRF |
| | | CDR-L2 | 23 | GAS |
| | | CDR-L3 | 24 | QQDSNLPIT |
| | Anti-CD38 (hyb5739) | CDR-H1 | 25 | GYAFTTYL |
| | | CDR-H2 | 26 | INPGSGST |
| | | CDR-H3 | 27 | ARYAYGY |
| | | CDR-L1 | 28 | QNVGTA |
| | | CDR-L2 | 29 | SAS |
| | | CDR-L3 | 30 | QQYSTYPFT |
| | Anti-CD38 (hyb6284) | CDR-H1 | 31 | GYSFTNYA |
| | | CDR-H2 | 32 | ISPYYGDT |
| | | CDR-H3 | 33 | ARRFEGFYYSMDY |
| | | CDR-L1 | 34 | QSLVHSNGNTY |
| | | CDR-L2 | 35 | KVS |
| | | CDR-L3 | 36 | SQSTHVPLT |
| | Anti-CD38 (hhy1195) | CDR-H1 | 37 | GFTFSSYG |
| | | CDR-H2 | 38 | IWYDGSNK |
| | | CDR-H3 | 39 | ARDPGLRYFDGGMDV |

TABLE 2-continued

Anti-CD38 binding protein sequences.

| Sequence Type | Molecule | Description | SEQ ID NO | Sequence |
|---|---|---|---|---|
| | | CDR-L1 | 40 | QGISSY |
| | | CDR-L2 | 41 | AAS |
| | | CDR-L3 | 42 | QQLNSFPYT |
| | Anti-CD38 (hhy1370) | CDR-H1 | 43 | GFTFSSYG |
| | | CDR-H2 | 44 | IWYDGSNK |
| | | CDR-H3 | 45 | ARMFRGAFDY |
| | | CDR-L1 | 46 | QGIRND |
| | | CDR-L2 | 47 | AAS |
| | | CDR-L3 | 48 | LQDYIYYPT |
| Variable domain | CD38 VH1 | VH | 79 | QVQLVQSGAEVVKPGASVKVSCKASG YTFTSYAMHWVKEAPGQRLEWIGYIYP GQGGTNYNQKFQGRATLTADTSASTA YMELSSLRSEDTAVYFCARTGGLRRAY FTYWGQGTLVTVSS |
| | | VL | 80 | DIVLTQSPATLSLSPGERATISCRASQSV SSYGQGFMHWYQQKPGQPPRLLIYGAS SRATGIPARFSGSGSGTDFTLTISPLEPED FAVYYCQQNKEDPWTFGGGTKLEIK |
| | CD38 hhy992 | VH | 81 | QVQLVQSGAEVKKPGASVKVSCKVSG YTLTEFSIHWVRQAPGQGLEWMGGFDP EDGETIYAQKFQGRVIMTEDTSTDTAY MEMNSLRSEDTAIYYCTTGRFFDWFWG QGTLVTVSS |
| | | VL | 82 | EIILTQSPAILSLSPGERATLSCRASQSVI SRFLSWYQVKPGLAPRLLIYGASTRATG IPVRFSGSGSGTDFSLTISSLQPEDCAVY YCQQDSNLPITFGQGTRLEIK |
| | CD38 hu5739 | VH | 83 | QVQLVQSGAEVKKPGASVKVSCKASG YAFTTYLVEWIRQRPGQGLEWMGVINP GSGSTNYAQKFQGRVTMTVDRSSTTAY MELSRLRSDDTAVYYCARYAYGYWGQ GTLVTVSS |
| | | VL | 84 | DIQMTQSPSSLSASVGDRVTITCRASQN VGTAVAWYQQKPGKSPKQLIYSASNRY TGVPSRFSGSGSGTDFTLTISSLQPEDLA TYYCQQYSTYPFTFGQGTKLEIK |
| | CD38 hu6284 | VH | 85 | QVQLVQSGAEVKKPGASVKVSCKASG YSFTNYAVHWVRQAPGQGLEWMGVIS PYYGDTTYAQKFQGRVTMTVDKSSSTA YMELSRLRSDDTAVYYCARRFEGFYYS MDYWGQGTLVTVSS |
| | | VL | 86 | DVVMTQSPLSLPVTLGQPASISCRPSQS LVHSNGNTYLNWYQQRPGQSPKLLIYK VSKRFSGVPDRFSGSGSGTDFTLKISRV EAEDVGVYYCSQSTHVPLTFGGGTKVE IK |
| | CD38 hhy1195 | VH | 87 | QVQLVESGGGVVQPGRSLRLSCAASGF TFSSYGMYWVRQAPGKGLEWVAVIWY DGSNKYYADSVKGRFTISRDNSKNTLY LQMNSLRAEDTAVYHCARDPGLRYFD GGMDVWGQGTTVTVSS |
| | | VL | 88 | DIQLTQSPSFLSASVGDRVTITCRASQGI SSYLAWYQQKPGKAPKLLIFAASTLHS GVPSRFSGSGSGTEFTLTISSLQPEDFAT YYCQQLNSFPYTFGQGTKLEIK |
| | CD38 hhy1370 | VH | 89 | QVQLVESGGGVVQPGRSLRLSCAASGF TFSSYGMHWVRQAPGKGLEWVAVIWY DGSNKYYADSVKGRFTISGDNSKNTLY LQMNSLRAEDTAVYYCARMFRGAFDY WGQGTLVTVSS |
| | | VL | 90 | AIQMTQSPSSLSASVGDRVTITCRASQGI RNDLGWYQQKPGKAPKLLIYAASSLQS GVPSRFSGSGSGTDFTLTISGLQPEDSAT YYCLQDYIYYPTFGQGTKVEIK |
| | CD38 hyb5739 | VH | 277 | QVQLQQSGPELVRPGTSVKVSCKASGY AFTTYLVEWIKQRPGQGLEWIGVINPGS GSTNYNEKFKGKATLTVDRSSTTAYMH LSGLTSDDSAVYFCARYAYGYWGQGT TLTVSS |
| | | VL | 278 | DIVMTQSQKFMSASVGDRVSITCKASQ NVGTAVAWYQQQPGHSPKQLIYSASNR YTGVPDRFTGSGAGTDFTLTISNIQSEDL ADYFCQQYSTYPFTFGSGTKLEIK |

TABLE 2-continued

Anti-CD38 binding protein sequences.

| Sequence Type | Molecule | Description | SEQ ID NO | Sequence |
|---|---|---|---|---|
| | CD38 hyb6284 | VH | 279 | QVQLLQSGAELVRPGVSVKISCTGSGYS FTNYAVHWVKQSHVKSLEWIGVISPYY GDTTYNQKFTGKATMTVDKSSSTAYM ELARLTSEDSAIYFCARRFEGFYYSMDY WGQGTSVTVSS |
| | | VL | 280 | DVVMIQTPLSLPVSLGDQASISCRPSQSL VHSNGNTYLNWYLQRPGQSPKLLIYKV SKRFSGVPDRFSGSGSGTDFTLKISRVE AEDLGVYLCSQSTHVPLTFGSGTQLEIK |

Further provided herein are antibodies (e.g., monospecific antibodies) comprising any of the anti-CD38 CDRs and/or variable domains described supra.

In some embodiments, a binding protein of the present disclosure comprises an antigen binding site that binds an extracellular domain of a human CD38 polypeptide and an extracellular domain of a cynomolgus monkey CD38 polypeptide. Exemplary assays for determining whether an antigen binding site binds an antigen are described herein and known in the art, including (without limitation) ELISA, SPR, and flow cytometry assays.

Anti-HER2 Binding Sites

Certain aspects of the present disclosure relate to binding proteins that comprise an antigen binding site that binds a HER2 polypeptide. In some embodiments, the HER2 polypeptide is a human HER2 polypeptide, also known as NEU, NGL, ERBB2, TKR1, CD340, HER-2, MLN19, and HER-2/neu. Human HER2 polypeptides are known in the art and include, without limitation, the polypeptides represented by NCBI Accession Numbers XP_024306411.1, XP_024306410.1, XP_024306409.1, NP_001276867.1, NP_001276866.1, NP_001276865.1, NP_001005862.1, or NP_004439.2, or a polypeptide produced from NCBI Gene ID Number 2064. In some embodiments, a binding protein comprising an antigen binding site that binds a HER2 polypeptide is monospecific and/or monovalent, bispecific and/or bivalent, trispecific and/or trivalent, or multispecific and/or multivalent. In some embodiments, a binding protein that comprises an antigen binding site that binds a HER2 polypeptide is a trispecific binding protein comprising four polypeptides that form three antigen binding sites as described supra, wherein $V_{H3}$ and $V_{L3}$ domain pair that form a third antigen binding site that binds a HER2 polypeptide.

In some embodiments, a binding site that binds HER2 comprises: an antibody heavy chain variable (VH) domain comprising a CDR-H1 sequence comprising the amino acid sequence of GFNIKDTY (SEQ ID NO:1) or GFNIRDTY (SEQ ID NO:2), a CDR-H2 sequence comprising the amino acid sequence of IYPTNGYT (SEQ ID NO:3), IYPTQGYT (SEQ ID NO:4), or IYPTNAYT (SEQ ID NO:5), and a CDR-H3 sequence comprising the amino acid sequence of SRWGGDGFYAMDY (SEQ ID NO:6), SRWGGEGFYAMDY (SEQ ID NO:7), or SRWGGSGFYAMDY (SEQ ID NO:8); and/or an antibody light chain variable (VL) domain comprising a CDR-L1 sequence comprising the amino acid sequence of QDVNTA (SEQ ID NO:9) or QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIKDTY (SEQ ID NO:1) or GFNIRDTY (SEQ ID NO:2), a CDR-H2 sequence comprising the amino acid sequence of IYPTNGYT (SEQ ID NO:3), IYPTQGYT (SEQ ID NO:4), or IYPTNAYT (SEQ ID NO:5), and a CDR-H3 sequence comprising the amino acid sequence of SRWGGDGFYAMDY (SEQ ID NO:6), SRWGGEGFYAMDY (SEQ ID NO:7), or SRWGGSGFYAMDY (SEQ ID NO:8); and an antibody light chain variable (VL) domain comprising a CDR-L1 sequence comprising the amino acid sequence of QDVNTA (SEQ ID NO:9) or QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIKDTY (SEQ ID NO:1), a CDR-H2 sequence comprising the amino acid sequence of IYPTNGYT (SEQ ID NO:3), and a CDR-H3 sequence comprising the amino acid sequence of SRWGGDGFYAMDY (SEQ ID NO:6); and/or an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIKDTY (SEQ ID NO:1), a CDR-H2 sequence comprising the amino acid sequence of IYPTNGYT (SEQ ID NO:3), and a CDR-H3 sequence comprising the amino acid sequence of SRWGGDGFYAMDY (SEQ ID NO:6); and an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGEGFYAMDY (SEQ ID NO:7); and/or an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGEGFYAMDY (SEQ ID NO:7); and an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGSGFYAMDY (SEQ ID NO:8); and/or an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGSGFYAMDY (SEQ ID NO:8); and an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGSGFYAMDY (SEQ ID NO:8); and/or an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGSGFYAMDY (SEQ ID NO:8); and an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGEGFYAMDY (SEQ ID NO:7); and/or an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGEGFYAMDY (SEQ ID NO:7); and an antibody light chain variable (VL) domain comprising a CDR-L1 sequence comprising the amino acid sequence of QDVNTA (SEQ ID NO:9), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIKDTY (SEQ ID NO:1), a CDR-H2 sequence comprising the amino acid sequence of IYPTNGYT (SEQ ID NO:3), and a CDR-H3 sequence comprising the amino acid sequence of SRWGGDGFYAMDY (SEQ ID NO:6); and/or an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIKDTY (SEQ ID NO:1), a CDR-H2 sequence comprising the amino acid sequence of IYPTNGYT (SEQ ID NO:3), and a CDR-H3 sequence comprising the amino acid sequence of SRWGGDGFYAMDY (SEQ ID NO:6); and an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGEGFYAMDY (SEQ ID NO:7), and a CDR-H3 sequence comprising the amino acid sequence of SRWGGSGFYAMDY (SEQ ID NO:8); and/or an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGEGFYAMDY (SEQ ID NO:7), and a CDR-H3 sequence comprising the amino acid sequence of SRWGGSGFYAMDY (SEQ ID NO:8); and an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGSGFYAMDY (SEQ ID NO:8); and/or an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGSGFYAMDY (SEQ ID NO:8); and an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGSGFYAMDY (SEQ ID NO:8); and/or an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTQGYT (SEQ ID NO:4), and a CDR-H3 sequence comprising the amino acid sequence of SRWGGSGFYAMDY (SEQ ID NO:8); and an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGEGFYAMDY (SEQ ID NO:7); and/or an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12). In some embodiments, a binding site that binds HER2 comprises: an antibody heavy chain variable (VH) domain comprising a CDR-H1 sequence comprising the amino acid sequence of GFNIRDTY (SEQ ID NO:2), a CDR-H2 sequence comprising the amino acid sequence of IYPTNAYT (SEQ ID NO:5), and a CDR-H3 sequence comprising the amino acid sequence of SRWGGEGFYAMDY (SEQ ID NO:7); and an antibody light chain variable (VL) domain comprising a CDR-L1 sequence comprising the amino acid sequence of QDVQTA (SEQ ID NO:10), a CDR-L2 sequence comprising the amino acid sequence of SAS (SEQ ID NO:11), and a CDR-L3 sequence comprising the amino acid sequence of QQHYTTP (SEQ ID NO:12).

In some embodiments, a binding site that binds HER2 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EVQLVESGGGLVQPGGSLRLSCAASGFNIKDTYIHWVRQAPGKGLEWVARIYPTNG YTRYADSVKGRFTISADTSKNTAYLQMNSLRAEDTAVYYCSRWGGDGFYAMDYW GQGTLVTVSS (SEQ ID NO:72), EVQLVESGGGLVQPGGSLRLSCAASGFNIRDTYIHWVRQAPGKGLEWVARIYPTQG YTRYADSVKGRFTISADTSKNTAYLQMNSLRAEDTAVYYCSRWGGEGFYAMDYW GQGTLVTVSS (SEQ ID NO:73), EVQLVESGGGLVQPGGSLRLSCAASGFNIRDTYIHWVRQAPGKGLEWVARIYPTQG YTRYADSVKGRFTISADTSKNTAYLQMNSLRAEDTAVYYCSRWGGSGFYAMDYW GQGTLVTVSS (SEQ ID NO:74), EVQLVESGGGLVQPGGSLRLSCAASGFNIRDTYIHWVRQAPGKGLEWVARIYPTNA YTRYADSVKGRFTISADTSKNTAYLQMNSLRAEDTAVYYCSRWGGSGFYAMDYW GQGTLVTVSS (SEQ ID NO:75), or EVQLVESGGGLVQPGGSLRLSCAASGFNIRDTYIHWVRQAPGKGLEWVARIYPTNA YTRYADSVKGRFTISADTSKNTAYLQMNSLRAEDTAVYYCSRWGGEGFYAMDYW GQGTLVTVSS (SEQ ID NO:76); and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQDVNTA-VAWYQQKPGKAPKLLIYSASFLYSG VPSRFSGSRSGTDFTLTISSLQPEDFA-TYYCQQHYTTPPTFGQGTKVEIK (SEQ ID NO:77) or DIQMTQSPSSLSASVGDRVTITCRASQDVQTA-VAWYQQKPGKAPKLLIYSASFLYSG VPSRFSGSRSGTDFTLTISSLQPEDFA-TYYCQQHYTTPPTFGQGTKVEIK (SEQ ID NO:78). In some embodiments, a binding site that binds HER2 comprises: an antibody heavy chain variable (VH) domain comprising the amino acid sequence of SEQ ID NO:72, SEQ ID NO:73, SEQ ID NO:74, SEQ ID NO:75, or SEQ ID NO:76; and/or an antibody light chain variable (VL) domain comprising the amino acid sequence of SEQ ID NO:77 or SEQ ID NO:78. In some embodiments, a binding site that binds HER2 comprises: an antibody heavy chain variable (VH) domain comprising the amino acid sequence of SEQ ID NO:72, SEQ ID NO:73, SEQ ID NO:74, SEQ ID NO:75, or SEQ ID NO:76; and an antibody light chain variable (VL) domain comprising the amino acid sequence of SEQ ID NO:77 or SEQ ID NO:78.

In some embodiments, a binding site that binds HER2 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EVQLVESGGGLVQPGGSLRLS-CAASGFNIKDTYIHWVRQAPGKGLEWVARIYPTNG YTRYADSVKGRFTISADTSKNTAYLQMNSLRAED-TAVYYCSRWGGDGFYAMDYW GQGTLVTVSS (SEQ ID NO:72), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQDVNTA-VAWYQQKPGKAPKLLIYSASFLYSG VPSRFSGSRSGTDFTLTISSLQPEDFA-TYYCQQHYTTPPTFGQGTKVEIK (SEQ ID NO:77). In some embodiments, a binding site that binds HER2 comprises: an antibody heavy chain variable (VH) domain comprising the amino acid sequence of SEQ ID NO:72, and/or an antibody light chain variable (VL) domain comprising the amino acid sequence of SEQ ID NO:77. In some embodiments, a binding site that binds HER2 comprises: an antibody heavy chain variable (VH) domain comprising the amino acid sequence of SEQ ID NO:72, and an antibody light chain variable (VL) domain comprising the amino acid sequence of SEQ ID NO:77.

In some embodiments, a binding site that binds HER2 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EVQLVESGGGLVQPGGSLRLS-CAASGFNIRDTYIHWVRQAPGKGLEWVARIYPTQG YTRYADSVKGRFTISADTSKNTAYLQMNSLRAED-TAVYYCSRWGGEGFYAMDYW GQGTLVTVSS (SEQ ID NO:73), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQDVNTA-VAWYQQKPGKAPKLLIYSASFLYSG VPSRFSGSRSGTDFTLTISSLQPEDFA-TYYCQQHYTTPPTFGQGTKVEIK (SEQ ID NO:77). In some embodiments, a binding site that binds HER2 comprises: an antibody heavy chain variable (VH) domain comprising the amino acid sequence of SEQ ID NO:73, and/or an antibody light chain variable (VL) domain comprising the amino acid sequence of SEQ ID NO:77. In some embodiments, a binding site that binds HER2 comprises: an antibody heavy chain variable (VH) domain comprising the amino acid sequence of SEQ ID NO:73, and an antibody light chain variable (VL) domain comprising the amino acid sequence of SEQ ID NO:77.

In some embodiments, a binding site that binds HER2 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EVQLVESGGGLVQPGGSLRLS-CAASGFNIRDTYIHWVRQAPGKGLEWVARIYPTNA YTRYADSVKGRFTISADTSKNTAYLQMNSLRAED-TAVYYCSRWGGSGFYAMDYW GQGTLVTVSS (SEQ ID NO:75), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQDVNTA-VAWYQQKPGKAPKLLIYSASFLYSG VPSRFSGSRSGTDFTLTISSLQPEDFA-TYYCQQHYTTPPTFGQGTKVEIK (SEQ ID NO:77). In some embodiments, a binding site that binds HER2 comprises: an antibody heavy chain variable (VH) domain comprising the amino acid sequence of SEQ ID NO:75, and/or an antibody light chain variable (VL) domain comprising the amino acid sequence of SEQ ID NO:77. In some embodiments, a binding site that binds HER2 comprises: an antibody heavy chain variable (VH) domain comprising the amino acid sequence of SEQ ID NO:75, and an antibody light chain variable (VL) domain comprising the amino acid sequence of SEQ ID NO:77.

In some embodiments, a binding site that binds HER2 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EVQLVESGGGLVQPGGSLRLS-CAASGFNIRDTYIHWVRQAPGKGLEWVARIYPTQG YTRYADSVKGRFTISADTSKNTAYLQMNSLRAED-TAVYYCSRWGGSGFYAMDYW GQGTLVTVSS (SEQ ID NO:74), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQDVNTA-VAWYQQKPGKAPKLLIYSASFLYSG VPSRFSGSRSGTDFTLTISSLQPEDFA- TYYCQQHYTTPPTFGQGTKVEIK (SEQ ID NO:77). In some embodiments, a binding site that binds HER2 comprises: an antibody heavy chain variable (VH) domain comprising the amino acid sequence of SEQ ID NO:74, and/or an antibody light chain variable (VL) domain comprising the amino acid sequence of SEQ ID NO:77. In some embodiments, a binding site that binds HER2 comprises: an antibody heavy chain variable (VH) domain comprising the amino acid sequence of SEQ ID NO:74, and an antibody light chain variable (VL) domain comprising the amino acid sequence of SEQ ID NO:77.

In some embodiments, a binding site that binds HER2 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EVQLVESGGGLVQPGGSLRLSCAASGFNIRDTYIHWVRQAPGKGLEWVARIYPTNAYTRYADSVKGRFTISADTSKNTAYLQMNSLRAEDTAVYYCSRWGGEGFYAMDYW GQGTLVTVSS (SEQ ID NO:76), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK (SEQ ID NO:77). In some embodiments, a binding site that binds HER2 comprises: an antibody heavy chain variable (VH) domain comprising the amino acid sequence of SEQ ID NO:76, and/or an antibody light chain variable (VL) domain comprising the amino acid sequence of SEQ ID NO:77. In some embodiments, a binding site that binds HER2 comprises: an antibody heavy chain variable (VH) domain comprising the amino acid sequence of SEQ ID NO:76, and an antibody light chain variable (VL) domain comprising the amino acid sequence of SEQ ID NO:77.

In some embodiments, a binding site that binds HER2 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYW GQGTLVTVSS (SEQ ID NO:72), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCRASQDVQTAVAWYQQKPGKAPKLLIYSASFLYSGVPSRFSGSRSGTDFTLTISSLQPEDFATYYCQQHYTTPPTFGQGTKVEIK (SEQ ID NO:78). In some embodiments, a binding site that binds HER2 comprises: an antibody heavy chain variable (VH) domain comprising the amino acid sequence of SEQ ID NO:72, and/or an antibody light chain variable (VL) domain comprising the amino acid sequence of SEQ ID NO:78. In some embodiments, a binding site that binds HER2 comprises: an antibody heavy chain variable (VH) domain comprising the amino acid sequence of SEQ ID NO:72, and an antibody light chain variable (VL) domain comprising the amino acid sequence of SEQ ID NO:78.

In some embodiments, an anti-HER2 antigen binding site of the present disclosure comprises 1, 2, 3, 4, 5, or all 6 CDR sequences of anti-HER2 antibody trastuzumab, 30R/55Q/102E, 30R/56A/102S, 30R/55Q/102S, 30R/56A/102E, or 30Q. In some embodiments, an anti-HER2 antigen binding site of the present disclosure comprises a VH domain sequence and/or VL domain sequence of anti-HER2 antibody trastuzumab, 30R/55Q/102E, 30R/56A/102S, 30R/55Q/102S, 30R/56A/102E, or 30Q.

Sequences of exemplary anti-HER2 antigen binding sites are provided in Table 3. In some embodiments, an anti-HER2 antigen binding site of the present disclosure comprises 1, 2, 3, 4, 5, or all 6 CDR sequences of an anti-HER2 antibody described in Table 3. In some embodiments, an anti-HER2 antigen binding site of the present disclosure comprises a VH domain sequence and/or VL domain sequence of an anti-HER2 antibody described in Table 3.

TABLE 3

Anti-HER2 binding protein sequences.

| Sequence Type | Molecule | Description | SEQ ID NO | Sequence |
|---|---|---|---|---|
| CDR | Anti-Her2 (trastuzumab) Heavy chain CDRs | CDR-H1 (original) | 1 | GFNIKDTY |
| | | CDR-H1 30R | 2 | GFNIRDTY |
| | | CDR-H2 (original) | 3 | IYPTNGYT |
| | | CDR-H2 55Q | 4 | IYPTQGYT |
| | | CDR-H2 56A | 5 | IYPTNAYT |
| | | CDR-H3 (original) | 6 | SRWGGDGFYAMDY |
| | | CDR-H3 102E | 7 | SRWGGEGFYAMDY |
| | | CDR-H3 102S | 8 | SRWGGSGFYAMDY |

TABLE 3-continued

| Anti-HER2 binding protein sequences. | | | | |
|---|---|---|---|---|
| Sequence Type | Molecule | Description | SEQ ID NO | Sequence |
| | Anti-Her2 (trastuzumab) Light chain CDRs | CDR-L1 (original) | 9 | QDVNTA |
| | | CDR-L1 30Q | 10 | QDVQTA |
| | | CDR-L2 (original) | 11 | SAS |
| | | CDR-L3 (original) | 12 | QQHYTTP |
| Variable domain | Anti-Her2 Trastuzumab and variant VH | VH wt | 72 | EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS |
| | | VH 30R/55Q/102E | 73 | EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGEGFYAMDYWGQGTLVTVSS |
| | | VH 30R/55Q/102S | 74 | EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGSGFYAMDYWGQGTLVTVSS |
| | | VH 30R/56A/102S | 75 | EVQLVESGGGLVQPGGSLRLSCAASGFNIRDTYIHWVRQAPGKGLEWVARIYPTNAYTRYADSVKGRFTISADTSKNTAYLQMNSLRAEDTAVYYCSRWGGSGFYAMDYWGQGTLVTVSS |
| | | VH 30R/56A/102E | 76 | EVQLVESGGGLVQPGGSLRLSCAASGFNIRDTYIHWVRQAPGKGLEWVARIYPTNAYTRYADSVKGRFTISADTSKNTAYLQMNSLRAEDTAVYYCSRWGGEGFYAMDYWGQGTLVTVSS |
| | Anti-Her2 Trastuzumab and variant VL | VL wt | 77 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK |
| | | VL 30Q | 78 | DIQMTQSPSSLSASVGDRVTITCRASQDVQTAVAWYQQKPGKAPKLLIYSASFLYSGVPSRFSGSRSGTDFTLTISSLQPEDFATYYCQQHYTTPPTFGQGTKVEIK |

Other Anti-Tumor Target Binding Sites

In some embodiments, a binding protein of the present disclosures comprises an antigen binding site that binds a tumor target protein. In some embodiments, the tumor target protein is a CD38 polypeptide (e.g., a human CD38 polypeptide). In some embodiments, the tumor target protein is a HER2 polypeptide (e.g., a human HER2 polypeptide). In some embodiments, a tumor target protein of the present disclosure includes, without limitation, A2AR, APRIL, ATPDase, BAFF, BAFFR, BCMA, BlyS, BTK, BTLA, B7DC, B7H1, B7H4 (also known as VTCN1), B7H5, B7H6, B7H7, B7RP1, B7-4, C3, C5, CCL2 (also known as MCP-1), CCL3 (also known as MIP-1a), CCL4 (also known as MIP-1b), CCL5 (also known as RANTES), CCL7 (also known as MCP-3), CCL8 (also known as mcp-2), CCL11 (also known as eotaxin), CCL15 (also known as MIP-1d), CCL17 (also known as TARC), CCL19 (also known as MIP-3b), CCL20 (also known as MIP-3a), CCL21 (also known as MIP-2), CCL24 (also known as MPIF-2/eotaxin-2), CCL25 (also known as TECK), CCL26 (also known as eotaxin-3), CCR3, CCR4, CD3, CD19, CD20, CD23 (also known as FCER2, a receptor for IgE), CD24, CD27, CD28, CD38, CD39, CD40, CD70, CD80 (also known as B7-1), CD86 (also known as B7-2), CD122, CD137 (also known as 41BB), CD137L, CD152 (also known as CTLA4), CD154 (also known as CD40L), CD160, CD272, CD273 (also known as PDL2), CD274 (also known as PDL1), CD275 (also known as B7H2), CD276 (also known as B7H3), CD278 (also known as ICOS), CD279 (also known as PD-1), CDH1 (also known as E-cadherin), chitinase, CLEC9, CLEC91, CRTH2, CSF-1 (also known as M-CSF), CSF-2 (also known as GM-CSF), CSF-3 (also known as GCSF), CX3CL1 (also known as SCYD1), CXCL12 (also known as SDF1), CXCL13, CXCR3, DNGR-1, ectonucleoside triphosphate diphosphohydrolase 1, EGFR, ENTPD1, FCER1A, FCER1, FLAP, FOLH1, Gi24, GITR, GITRL, GM-CSF, Her2, HHLA2, HMGB1, HVEM, ICOSLG, IDO, IFNα, IgE, IGF1R, IL2Rbeta, IL1, IL1A, IL1B, IL1F10, IL2, IL4, IL4Ra, IL5, IL5R, IL6, IL7, IL7Ra, IL8, IL9, IL9R, IL10, rhIL10, IL12, IL13, IL13Ra1, IL13Ra2, IL15, IL17, IL17Rb (also known as a receptor for IL25), IL18, IL22, IL23, IL25, IL27, IL33, IL35, ITGB4 (also known as b4 integrin), ITK, KIR, LAG3, LAMP1, leptin, LPFS2, MHC class II, MUC-1, NCR3LG1, NKG2D, NTPDase-1, OX40, OX40L, PD-1H, platelet receptor, PROM1, 5152, SISP1, SLC, SPG64, ST2 (also known as a receptor for IL33), STEAP2, Syk kinase, TACI, TDO, T14, TIGIT, TIM3, TLR, TLR2, TLR4, TLR5, TLR9, TMEF1, TNFα, TNFRSF7, Tp55, TREM1, TSLP (also known as a co-receptor for IL7Ra), TSLPR, TWEAK, VEGF, VISTA, Vstm3, WUCAM, and XCR1 (also known as GPR5/CCXCR1). In some embodiments, one or more of the above antigen targets are human antigen targets.

Anti-CD28 Binding Sites

Certain aspects of the present disclosure relate to binding proteins that comprise an antigen binding site that binds a CD28 polypeptide. In some embodiments, the CD28 polypeptide is a human CD28 polypeptide, also known as Tp44. Human CD28 polypeptides are known in the art and include, without limitation, the polypeptides represented by NCBI Accession Numbers XP_011510499.1, XP_011510497.1, XP_011510496.1, NP_001230007.1, NP_001230006.1, or NP_006130.1, or a polypeptide produced from NCBI Gene ID Number 940. In some embodiments, a binding protein comprising an antigen binding site that binds a CD28 polypeptide is monospecific and/or monovalent, bispecific and/or bivalent, trispecific and/or trivalent, or multispecific and/or multivalent. In some embodiments, a binding protein that comprises an antigen binding site that binds a CD28 polypeptide is a trispecific binding protein comprising four polypeptides that form three antigen binding sites. In some embodiments, a binding protein that comprises an antigen binding site that binds a CD28 polypeptide is a trispecific binding protein comprising four polypeptides that form three antigen binding sites, one of which binds a CD28 polypeptide, and one of which binds a CD3 polypeptide. In some embodiments, a binding protein that comprises an antigen binding site that binds a CD3 polypeptide is a trispecific binding protein comprising four polypeptides that form three antigen binding sites, one of which binds a CD28 polypeptide, one of which binds a CD3 polypeptide, and one of which binds a CD38 polypeptide. In some embodiments, a binding protein that comprises an antigen binding site that binds a CD3 polypeptide is a trispecific binding protein comprising four polypeptides that form three antigen binding sites, one of which binds a CD28 polypeptide, one of which binds a CD3 polypeptide, and one of which binds a HER2 polypeptide. In some embodiments, a binding protein that comprises an antigen binding site that binds a CD3 polypeptide is a trispecific binding protein comprising four polypeptides that form three antigen binding sites, one of which binds a CD28 polypeptide, one of which binds a CD3 polypeptide, and one of which binds a tumor target protein.

In some embodiments, a binding site that binds CD28 comprises: an antibody heavy chain variable (VH) domain comprising a CDR-H1 sequence comprising the amino acid sequence of GYTFTSYY (SEQ ID NO:49), a CDR-H2 sequence comprising the amino acid sequence of IYPGNVNT (SEQ ID NO:50), and a CDR-H3 sequence comprising the amino acid sequence of TRSHYGLDWNFDV (SEQ ID NO:51) and/or an antibody light chain variable (VL) domain comprising a CDR-L1 sequence comprising the amino acid sequence of QNIYVW (SEQ ID NO:52), a CDR-L2 sequence comprising the amino acid sequence of KAS (SEQ ID NO:53), and a CDR-L3 sequence comprising the amino acid sequence of QQGQTYPY (SEQ ID NO:54). In some embodiments, a binding site that binds CD28 comprises: an antibody heavy chain variable (VH) domain comprising a CDR-H1 sequence comprising the amino acid sequence of GYTFTSYY (SEQ ID NO:49), a CDR-H2 sequence comprising the amino acid sequence of IYPGNVNT (SEQ ID NO:50), and a CDR-H3 sequence comprising the amino acid sequence of TRSHYGLDWNFDV (SEQ ID NO:51); and an antibody light chain variable (VL) domain comprising a CDR-L1 sequence comprising the amino acid sequence of QNIYVW (SEQ ID NO:52), a CDR-L2 sequence comprising the amino acid sequence of KAS (SEQ ID NO:53), and a CDR-L3 sequence comprising the amino acid sequence of QQGQTYPY (SEQ ID NO:54).

In some embodiments, a binding site that binds CD28 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVQSGAEVVKPGASVKVSCKASGYTFTSYYIHWVRQAPGQGLEWIGSIYPGNV NTNYAQKFQGRATLTVDTSISTAYMELSRLRSDDTAVYYCTRSHYGLDWNFDVWG KGTTVTVSS (SEQ ID NO:91), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCQASQNIYVWLNWYQQKPGKAPKLLIYKASNLHTG VPSRFSGSGSGTDFTLTISSLQPEDIATYYCQQGQTYPYTFGQGTKLEIK (SEQ ID NO:92). In some embodiments, a binding site that binds CD28 comprises: an antibody heavy chain variable (VH) domain comprising the amino acid sequence of SEQ ID NO:91, and/or an antibody light chain variable (VL) domain comprising the amino acid sequence of SEQ ID NO:92. In some embodiments, a binding site that binds CD28 comprises: an antibody heavy chain variable (VH) domain comprising the amino acid sequence of SEQ ID NO:91, and an antibody light chain variable (VL) domain comprising the amino acid sequence of SEQ ID NO:92.

In some embodiments of any of the above embodiments, the binding protein is a trispecific binding protein. In some embodiments, the trispecific binding protein comprising an antigen binding site that binds a tumor target protein (including, without limitation, CD38 or HER2), an antigen binding site that binds a CD28 polypeptide, and an antigen binding site that binds a CD3 polypeptide. In some embodiments, the binding protein is a trispecific binding protein comprising four polypeptides comprising three antigen binding sites, wherein the polypeptide of formula I and the polypeptide of formula II form a cross-over light chain-heavy chain pair (e.g., as described herein). In some embodiments, the VH and VL domains of any of the anti-CD28 antigen binding sites described above represent $V_{H1}$ and $V_{L1}$ and form a first antigen binding site that binds a CD28 polypeptide. In some embodiments, the VH and VL domains of any of the anti-CD28 antigen binding sites described above and/or in Table 4 represent $V_{H1}$ and VL and form a first antigen binding site that binds a CD28 polypeptide, $V_{H2}$ and $V_{L2}$ form a second antigen binding site that binds a CD3 polypeptide, and $V_{H3}$ and $V_{L3}$ and form a third antigen binding site that binds a tumor target protein (including, without limitation, CD38 or HER2).

Sequences of exemplary anti-CD28 antigen binding sites are provided in Table 4. In some embodiments, an anti-CD28 antigen binding site of the present disclosure comprises 1, 2, 3, 4, 5, or all 6 CDR sequences of an anti-CD28 antibody described in Table 4. In some embodiments, an anti-CD28 antigen binding site of the present disclosure comprises a VH domain sequence and/or VL domain sequence of an anti-CD28 antibody described in Table 4.

TABLE 4

Anti-CD28 binding protein sequences.

| Sequence Type | Molecule | Description | SEQ ID NO | Sequence |
|---|---|---|---|---|
| CDR | Anti-CD28 (sup) | CDR-H1 | 49 | GYTFTSYY |
| | | CDR-H2 | 50 | IYPGNVNT |
| | | CDR-H3 | 51 | TRSHYGLDWNFDV |
| | | CDR-L1 | 52 | QNIYVW |
| | | CDR-L2 | 53 | KAS |
| | | CDR-L3 | 54 | QQGQTYPY |
| Variable domain | Anti-CD28 (sup) | VH | 91 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSS |
| | | VL | 92 | DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIK |

Anti-CD3 Binding Sites

Certain aspects of the present disclosure relate to binding proteins that comprise an antigen binding site that binds a CD3 polypeptide. In some embodiments, the CD3 polypeptide is a human CD3 polypeptide, including CD3-delta (also known as T3D, IMD19, and CD3-DELTA), CD3-epsilon (also known as T3E, IMD18, and TCRE), and CD3-gamma (also known as T3G, IMD17, and CD3-GAMMA). Human CD3 polypeptides are known in the art and include, without limitation, the polypeptides represented by NCBI Accession Numbers XP_006510029.1 or NP_031674.1, or a polypeptide produced from NCBI Gene ID Numbers 915, 916, or 917. In some embodiments, a binding protein comprising an antigen binding site that binds a CD3 polypeptide is monospecific and/or monovalent, bispecific and/or bivalent, trispecific and/or trivalent, or multispecific and/or multivalent. In some embodiments, a binding protein that comprises an antigen binding site that binds a CD3 polypeptide is a trispecific binding protein comprising four polypeptides that form three antigen binding sites. In some embodiments, a binding protein that comprises an antigen binding site that binds a CD3 polypeptide is a trispecific binding protein comprising four polypeptides that form three antigen binding sites, one of which binds a CD28 polypeptide, and one of which binds a CD3 polypeptide. In some embodiments, a binding protein that comprises an antigen binding site that binds a CD3 polypeptide is a trispecific binding protein comprising four polypeptides that form three antigen binding sites, one of which binds a CD28 polypeptide, one of which binds a CD3 polypeptide, and one of which binds a CD38 polypeptide. In some embodiments, a binding protein that comprises an antigen binding site that binds a CD3 polypeptide is a trispecific binding protein comprising four polypeptides that form three antigen binding sites, one of which binds a CD28 polypeptide, one of which binds a CD3 polypeptide, and one of which binds a HER2 polypeptide. In some embodiments, a binding protein that comprises an antigen binding site that binds a CD3 polypeptide is a trispecific binding protein comprising four polypeptides that form three antigen binding sites, one of which binds a CD28 polypeptide, one of which binds a CD3 polypeptide, and one of which binds a tumor target protein.

In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHX$_1$NX$_2$X$_3$TY, wherein X$_1$ is E or Q, X$_2$ is A or L, and X$_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, the CDR-L1 sequence of the V$_{L2}$ domain comprises an amino acid sequence selected from the group consisting of QSLVHQNAQTY (SEQ ID NO:59), QSLVHENLQTY (SEQ ID NO:60), QSLVHENLFTY (SEQ ID NO:61), and QSLVHENLRTY (SEQ ID NO:62).

In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHQNAQTY (SEQ ID NO:59), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and an antibody light chain variable (VL) domain comprising a CDR-L1 sequence comprising the amino acid sequence of QSLVHQNAQTY (SEQ ID NO:59), a CDR-L2 sequence comprising the amino acid sequence of KVS (SEQ ID NO:64), and a CDR-L3 sequence comprising the amino acid sequence of GQGTQYPFT (SEQ ID NO:65).

In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHENLQTY (SEQ ID NO:60), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and an antibody light chain variable (VL) domain comprising a CDR-L1 sequence comprising the amino acid sequence of QSLVHENLQTY (SEQ ID NO:60), a CDR-L2 sequence comprising the amino acid sequence of KVS (SEQ ID NO:64), and a CDR-L3 sequence comprising the amino acid sequence of GQGTQYPFT (SEQ ID NO:65).

In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHENLFTY (SEQ ID NO:61), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and an antibody light chain variable (VL) domain comprising a CDR-L1 sequence comprising the amino acid sequence of QSLVHENLFTY (SEQ ID NO:61), a CDR-L2 sequence comprising the amino acid sequence of KVS (SEQ ID NO:64), and a CDR-L3 sequence comprising the amino acid sequence of GQGTQYPFT (SEQ ID NO:65).

In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and/or an antibody light chain variable (VL) domain comprising a CDR-L1 sequence comprising the amino acid sequence of QSLVHENLRTY (SEQ ID NO:62), a CDR-L2 sequence comprising the amino acid sequence of KVS (SEQ ID NO:64), and a CDR-L3 sequence comprising the amino acid sequence of GQGTQYPFT (SEQ ID NO:65). In some embodiments, a binding site that binds CD3 comprises: an antibody heavy chain variable (VH) domain comprising a CDR-H1 sequence comprising the amino acid sequence of GFTFTKAW (SEQ ID NO:55), a CDR-H2 sequence comprising the amino acid sequence of IKDKSNSYAT (SEQ ID NO:56), and a CDR-H3 sequence comprising the amino acid sequence of RGVYYALSPFDY (SEQ ID NO:57); and an antibody light chain variable (VL) domain comprising a CDR-L1 sequence comprising the amino acid sequence of QSLVHENLRTY (SEQ ID NO:62), a CDR-L2 sequence comprising the amino acid sequence of KVS (SEQ ID NO:64), and a CDR-L3 sequence comprising the amino acid sequence of GQGTQYPFT (SEQ ID NO:65).

In some embodiments, a binding site that binds CD3 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDY WGQGTLVTVSS (SEQ ID NO:93), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to an amino acid sequence selected from the group consisting of DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIK (SEQ ID NO:95), DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIK (SEQ ID NO:96), DIVMTQTPLSLSVTPGQPASISCKSSQSLVHENLFTYLSWYLQKPGQSPQSLIYKVSNRFSGVPDRFSGSGSGTDFTLKISRVEAEDVGVYYCGQGTQYPFTFGSGTKVEIK (SEQ ID NO:97), and DIVMTQTPLSLSVTPGQPASISCKSSQSLVHENLRTYLSWYLQKPGQSPQSLIYKVSNRFSGVPDRFSGSGSGTDFTLKISRVEAEDVGVYYCGQGTQYPFTFGSGTKVEIK (SEQ ID NO:98). In some embodiments, a binding site that binds CD3 comprises: an antibody heavy chain variable (VH) domain comprising the amino acid sequence of SEQ ID NO:93, and/or an antibody light chain variable (VL) domain comprising an amino acid sequence selected from the group consisting of SEQ ID NO:95, SEQ ID NO:96, SEQ ID NO:97, and SEQ ID NO:98. In some embodiments, a binding site that binds CD3 comprises: an antibody heavy chain variable (VH) domain comprising the amino acid sequence of SEQ ID NO:93, and an antibody light chain variable (VL) domain comprising an amino acid sequence selected from the group consisting of SEQ ID NO:95, SEQ ID NO:96, SEQ ID NO:97, and SEQ ID NO:98.

In some embodiments, a binding site that binds CD3 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDY WGQGTLVTVSS (SEQ ID NO:93), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHQNAQ-TYLSWYLQKPGQSPQSLIYKVSN RFSGVPDRFSGSGSGTDFTLKISRVEAE-DVGVYYCGQGTQYPFTFGSGTKVEIK (SEQ ID NO:95). In some embodiments, a binding site that binds CD3 comprises: an antibody heavy chain variable (VH) domain comprising the amino acid sequence of SEQ ID NO:93, and/or an antibody light chain variable (VL) domain comprising the amino acid sequence of SEQ ID NO:95. In some embodiments, a binding site that binds CD3 comprises: an antibody heavy chain variable (VH) domain comprising the amino acid sequence of SEQ ID NO:93, and an antibody light chain variable (VL) domain comprising the amino acid sequence of SEQ ID NO:95.

In some embodiments, a binding site that binds CD3 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:93), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHENLQ-TYLSWYLQKPGQSPQSLIYKVSN RFSGVPDRFSGSGSGTDFTLKISRVEAE-DVGVYYCGQGTQYPFTFGSGTKVEIK (SEQ ID NO:96). In some embodiments, a binding site that binds CD3 comprises: an antibody heavy chain variable (VH) domain comprising the amino acid sequence of SEQ ID NO:93, and/or an antibody light chain variable (VL) domain comprising the amino acid sequence of SEQ ID NO:96. In some embodiments, a binding site that binds CD3 comprises: an antibody heavy chain variable (VH) domain comprising the amino acid sequence of SEQ ID NO:93, and an antibody light chain variable (VL) domain comprising the amino acid sequence of SEQ ID NO:96.

In some embodiments, a binding site that binds CD3 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:93), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHENLF-TYLSWYLQKPGQSPQSLIYKVSNR FSGVPDRFSGSGSGTDFTLKISRVEAE-DVGVYYCGQGTQYPFTFGSGTKVEIK (SEQ ID NO:97). In some embodiments, a binding site that binds CD3 comprises: an antibody heavy chain variable (VH) domain comprising the amino acid sequence of SEQ ID NO:93, and/or an antibody light chain variable (VL) domain comprising the amino acid sequence of SEQ ID NO:97. In some embodiments, a binding site that binds CD3 comprises: an antibody heavy chain variable (VH) domain comprising the amino acid sequence of SEQ ID NO:93, and an antibody light chain variable (VL) domain comprising the amino acid sequence of SEQ ID NO:97.

In some embodiments, a binding site that binds CD3 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:93), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHENLR-TYLSWYLQKPGQSPQSLIYKVSN RFSGVPDRFSGSGSGTDFTLKISRVEAE-DVGVYYCGQGTQYPFTFGSGTKVEIK (SEQ ID NO:98). In some embodiments, a binding site that binds CD3 comprises: an antibody heavy chain variable (VH) domain comprising the amino acid sequence of SEQ ID NO:93, and/or an antibody light chain variable (VL) domain comprising the amino acid sequence of SEQ ID NO:98. In some embodiments, a binding site that binds CD3 comprises: an antibody heavy chain variable (VH) domain comprising the amino acid sequence of SEQ ID NO:93, and an antibody light chain variable (VL) domain comprising the amino acid sequence of SEQ ID NO:98.

In some embodiments, a binding site that binds CD3 comprises: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVESGGGVVQPGRSLRLS-CAASGFTFTKAWMHWVRQAPGKQLEWVAQIKDKS NSYATYYASSVKGRFTISRDDSKNTLYLQMNSLRAE-DTAVYYCRGVYYALSPFDYW GQGTLVTVSS (SEQ ID NO:595), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHQNAQ-TYLSWYLQKPGQSPQSLIYKVSN RFSGVPDRFSGSGSGTDFTLKISRVEAE-DVGVYYCGQGTQYPFTFGSGTKVEIK (SEQ ID NO:95). In some embodiments, a binding site that binds CD3 comprises: an antibody heavy chain variable (VH)

domain comprising the amino acid sequence of SEQ ID NO:595, and/or an antibody light chain variable (VL) domain comprising the amino acid sequence of SEQ ID NO:95. In some embodiments, a binding site that binds CD3 comprises: an antibody heavy chain variable (VH) domain comprising the amino acid sequence of SEQ ID NO:595, and an antibody light chain variable (VL) domain comprising the amino acid sequence of SEQ ID NO:95

In some embodiments of any of the above embodiments, the binding protein is a trispecific binding protein. In some embodiments, the trispecific binding protein comprising an antigen binding site that binds a tumor target protein (including, without limitation, CD38 or HER2), an antigen binding site that binds a CD28 polypeptide, and an antigen binding site that binds a CD3 polypeptide. In some embodiments, the binding protein is a trispecific binding protein comprising four polypeptides comprising three antigen binding sites, wherein the polypeptide of formula I and the polypeptide of formula II form a cross-over light chain-heavy chain pair (e.g., as described herein). In some embodiments, the VH and VL domains of any of the anti-CD3 antigen binding sites described above represent $V_{H2}$ and $V_{L2}$ and form a second antigen binding site that binds a CD3 polypeptide. In some embodiments, $V_{H1}$ and $V_{L1}$ form a first antigen binding site that binds a CD28 polypeptide, the VH and VL domains of any of the anti-CD3 antigen binding sites described above and/or in Table 5 represent $V_{H2}$ and $V_{L2}$ and form a second antigen binding site that binds a CD3 polypeptide, and $V_{H3}$ and $V_{L3}$ form a third antigen binding site that binds a tumor target protein (including, without limitation, CD38 or HER2).

Sequences of exemplary anti-CD3 antigen binding sites are provided in Table 5. In some embodiments, an anti-CD3 antigen binding site of the present disclosure comprises 1, 2, 3, 4, 5, or all 6 CDR sequences of an anti-CD3 antibody described in Table 5. In some embodiments, an anti-CD3 antigen binding site of the present disclosure comprises a VH domain sequence and/or VL domain sequence of an anti-CD3 antibody described in Table 5.

TABLE 5

Anti-CD3 binding protein sequences.

| Sequence Type | Molecule | Description | SEQ ID NO | Sequence |
|---|---|---|---|---|
| CDR | Anti-CD3 (mid) | CDR-H1 original | 55 | GFTFTKAW |
| | | CDR-H2 original | 56 | IKDKSNSYAT |
| | | CDR-H3 original | 57 | RGVYYALSPFDY |
| | | CDR-L1 original | 58 | QSLVHNNANTY |
| | | CDR-L1 QQ | 59 | QSLVHQNAQTY |
| | | CDR-L1 ENLQ | 60 | QSLVHENLQTY |
| | | CDR-L1 ENLF | 61 | QSLVHENLFTY |
| | | CDR-L1 ENLR | 62 | QSLVHENLRTY |
| | | CDR-L1 DNAQ | 63 | QSLVHDNAQTY |
| | | CDR-L2 original | 64 | KVS |
| | | CDR-L3 Original | 65 | GQGTQYPFT |
| | | CD3mid consensus CDR-L1 | 180 | QSLVH$X_1$N$X_2X_3$TY, wherein $X_1$ is E or Q, $X_2$ is A or L, and $X_3$ is Q, R, or F |
| Variable Domain | Anti-CD3 (mid) | VH | 93 | QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSS |
| | | VL Original | 94 | DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIK |
| | | VL 32/35 QQ | 95 | DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIK |
| | | VL ENLQ | 96 | DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIK |
| | | VL ENLF | 97 | DIVMTQTPLSLSVTPGQPASISCKSSQSLVHENLFTYLSWYLQKPGQSPQSLIYKVSNRFSGVPDRFSGSGSGTDFTLKISRVEAEDVGVYYCGQGTQYPFTFGSGTKVEIK |

TABLE 5-continued

| Sequence Type | Molecule | Description | SEQ ID NO | Sequence |
|---|---|---|---|---|
| Anti-CD3 binding protein sequences. | | | | |
| | | VL ENLR | 98 | DIVMTQTPLSLSVTPGQPASISCKSSQSL VHENLRTYLSWYLQKPGQSPQSLIYKVS NRFSGVPDRFSGSGSGTDFTLKISRVEAE DVGVYYCGQGTQYPFTFGSGTKVEIK |
| | | VL DNAQ | 99 | DIVMTQTPLSLSVTPGQPASISCKSSQSL VHDNAQTYLSWYLQKPGQSPQSLIYKVS NRFSGVPDRFSGSGSGTDFTLKISRVEAE DVGVYYCGQGTQYPFTFGSGTKVEIK |
| | | VH 185S | 595 | QVQLVESGGGVVQPGRSLRLSCAASGFT FTKAWMHWVRQAPGKQLEWVAQIKDK SNSYATYYASSVKGRFTISRDDSKNTLY LQMNSLRAEDTAVYYCRGVYYALSPFD YWGQGTLVTVSS |

Linkers

In some embodiments, the linkers $L_1$, $L_2$, $L_3$, and $L_4$ range from no amino acids (length=0) to about 100 amino acids long, or less than 100, 50, 40, 30, 20, or 15 amino acids or less. The linkers can also be 10, 9, 8, 7, 6, 5, 4, 3, 2, or 1 amino acids long. $L_1$, $L_2$, $L_3$, and $L_4$ in one binding protein may all have the same amino acid sequence or may all have different amino acid sequences.

Examples of suitable linkers include, for example, GGGGSGGGGS (SEQ ID NO:69), GGGGSGGGGSGGGGS (SEQ ID NO: 70), S, RT, TKGPS (SEQ ID NO: 68), GQPKAAP (SEQ ID NO: 67), GGSGSSGSGG (SEQ ID NO: 71), and DKTHT (SEQ ID NO:66), as well as those disclosed in International Publication Nos. WO2017/074878 and WO2017/180913. The examples listed above are not intended to limit the scope of the disclosure in any way, and linkers comprising randomly selected amino acids selected from the group consisting of valine, leucine, isoleucine, serine, threonine, lysine, arginine, histidine, aspartate, glutamate, asparagine, glutamine, glycine, and proline have been shown to be suitable in the binding proteins.

The identity and sequence of amino acid residues in the linker may vary depending on the type of secondary structural element necessary to achieve in the linker. For example, glycine, serine, and alanine are best for linkers having maximum flexibility. Some combination of glycine, proline, threonine, and serine are useful if a more rigid and extended linker is necessary. Any amino acid residue may be considered as a linker in combination with other amino acid residues to construct larger peptide linkers as necessary depending on the desired properties.

In some embodiments, the length of $L_1$ is at least twice the length of $L_3$. In some embodiments, the length of $L_2$ is at least twice the length of $L_4$. In some embodiments, the length of $L_1$ is at least twice the length of $L_3$, and the length of $L_2$ is at least twice the length of $L_4$. In some embodiments, $L_1$ is 3 to 12 amino acid residues in length, $L_2$ is 3 to 14 amino acid residues in length, $L_3$ is 1 to 8 amino acid residues in length, and $L_4$ is 1 to 3 amino acid residues in length. In some embodiments, $L_1$ is 5 to 10 amino acid residues in length, $L_2$ is 5 to 8 amino acid residues in length, $L_3$ is 1 to 5 amino acid residues in length, and $L_4$ is 1 to 2 amino acid residues in length. In some embodiments, $L_1$ is 7 amino acid residues in length, $L_2$ is 5 amino acid residues in length, $L_3$ is 1 amino acid residue in length, and $L_4$ is 2 amino acid residues in length.

In some embodiments, $L_1$, $L_2$, $L_3$ and $L_4$ each independently are zero amino acids in length or comprise a sequence selected from the group consisting of GGGGSGGGGS (SEQ ID NO:69), GGGGSGGGGSGGGGS (SEQ ID NO: 70), S, RT, TKGPS (SEQ ID NO: 68), GQPKAAP (SEQ ID NO: 67), and GGSGSSGSGG (SEQ ID NO: 71). In some embodiments, $L_1$, $L_2$, $L_3$ and $L_4$ each independently comprise a sequence selected from the group consisting of GGGGSGGGGS (SEQ ID NO:69), GGGGSGGGGSGGGGS (SEQ ID NO: 70), S, RT, TKGPS (SEQ ID NO: 68), GQPKAAP (SEQ ID NO: 67), and GGSGSSGSGG (SEQ ID NO: 71). In some embodiments, $L_1$ comprises the sequence GQPKAAP (SEQ ID NO: 67), $L_2$ comprises the sequence TKGPS (SEQ ID NO:68), $L_3$ comprises the sequence S, and $L_4$ comprises the sequence RT.

In some embodiments, at least one of $L_1$, $L_2$, $L_3$ or $L_4$ comprises the sequence DKTHT (SEQ ID NO:66). In some embodiments, $L_1$, $L_2$, $L_3$ and $L_4$ comprise the sequence DKTHT (SEQ ID NO:66).

Fc Regions and Constant Domains

In some embodiments, a binding protein of the present disclosure comprises a second polypeptide chain further comprising an Fc region linked to $C_{H1}$, the Fc region comprising an immunoglobulin hinge region and $C_{H2}$ and $C_{H3}$ immunoglobulin heavy chain constant domains. In some embodiments, a binding protein of the present disclosure comprises a third polypeptide chain further comprising an Fc region linked to $C_{H1}$, the Fc region comprising an immunoglobulin hinge region and $C_{H2}$ and $C_{H3}$ immunoglobulin heavy chain constant domains. In some embodiments, a binding protein of the present disclosure comprises a second polypeptide chain further comprising an Fc region linked to $C_{H1}$, the Fc region comprising an immunoglobulin hinge region and $C_{H2}$ and $C_{H3}$ immunoglobulin heavy chain constant domains, and a third polypeptide chain further comprising an Fc region linked to $C_{H1}$, the Fc region comprising an immunoglobulin hinge region and $C_{H2}$ and $C_{H3}$ immunoglobulin heavy chain constant domains.

In some embodiments, a binding protein of the present disclosure comprises a full-length antibody heavy chain or a polypeptide chain comprising an Fc region. In some embodiments, the Fc region is a human Fc region, e.g., a human IgG1, IgG2, IgG3, or IgG4 Fc region. In some embodiments, the Fc region includes an antibody hinge, $C_{H1}$, $C_{H2}$, $C_{H3}$, and optionally $C_{H4}$ domains. In some embodiments, the Fc region is a human IgG1 Fc region. In some embodiments, the Fc region is a human IgG4 Fc region. In some embodiments, the Fc region includes one or more of the mutations described infra. In some embodiments, the Fc region is an Fc region of one of the heavy chain polypeptides (e.g., polypeptide 2 or 3) of a binding protein shown in Table 4. In some embodiments, the heavy chain constant region is a constant region of one of the heavy chain polypeptides (e.g., polypeptide 2 or 3) of a binding protein shown in Table 4. In some embodiments, the light chain constant region is a constant region of one of the light chain polypeptides (e.g., polypeptide 1 or 4) of a binding protein shown in Table 4.

In some embodiments, a binding protein of the present disclosure includes one or two Fc variants. The term "Fe variant" as used herein refers to a molecule or sequence that is modified from a native Fc but still comprises a binding site for the salvage receptor, FcRn (neonatal Fc receptor). Exemplary Fc variants, and their interaction with the salvage receptor, are known in the art. Thus, the term "Fe variant" can comprise a molecule or sequence that is humanized from a non-human native Fc. Furthermore, a native Fc comprises regions that can be removed because they provide structural features or biological activity that are not required for the antibody-like binding proteins of the invention. Thus, the term "Fe variant" comprises a molecule or sequence that lacks one or more native Fc sites or residues, or in which one or more Fe sites or residues has be modified, that affect or are involved in: (1) disulfide bond formation, (2) incompatibility with a selected host cell, (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC).

In some embodiments, a binding protein of the present disclosure (e.g., a trispecific binding protein) comprises a "knob" mutation on the second polypeptide chain and a "hole" mutation on the third polypeptide chain. In some embodiments, a binding protein of the present disclosure comprises a "knob" mutation on the third polypeptide chain and a "hole" mutation on the second polypeptide chain. In some embodiments, the "knob" mutation comprises substitution(s) at positions corresponding to positions 354 and/or 366 of human IgG1 or IgG4 according to EU Index. In some embodiments, the amino acid substitutions are S354C, T366W, T366Y, S354C and T366W, or S354C and T366Y. In some embodiments, the "knob" mutation comprises substitutions at positions corresponding to positions 354 and 366 of human IgG1 or IgG4 according to EU Index. In some embodiments, the amino acid substitutions are S354C and T366W. In some embodiments, the "hole" mutation comprises substitution(s) at positions corresponding to positions 407 and, optionally, 349, 366, and/or 368 and of human IgG1 or IgG4 according to EU Index. In some embodiments, the amino acid substitutions are Y407V or Y407T and optionally Y349C, T366S, and/or L368A. In some embodiments, the "hole" mutation comprises substitutions at positions corresponding to positions 349, 366, 368, and 407 of human IgG1 or IgG4 according to EU Index. In some embodiments, the amino acid substitutions are Y349C, T366S, L368A, and Y407V.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution(s) at positions corresponding to positions 366 and optionally 354 of human IgG1 or IgG4 according to EU Index, wherein the amino acid substitutions are T366W or T366Y and optionally S354C; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution(s) at positions corresponding to positions 407 and optionally 349, 366, and/or 368 and of human IgG1 or IgG4 according to EU Index, wherein the amino acid substitutions are Y407V or Y407T and optionally Y349C, T366S, and/or L368A.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution(s) at positions corresponding to positions 407 and optionally 349, 366, and/or 368 and of human IgG1 or IgG4 according to EU Index, wherein the amino acid substitutions are Y407V or Y407T and optionally Y349C, T366S, and/or L368A; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution(s) at positions corresponding to positions 366 and optionally 354 of human IgG1 or IgG4 according to EU Index, wherein the amino acid substitutions are T366W or T366Y and optionally S354C.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution at position corresponding to position 366 of human IgG1 or IgG4 according to EU Index, wherein the amino acid substitution is T366W; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution(s) at positions corresponding to positions 366, 368, and/or 407 and of human IgG1 or IgG4 according to EU Index, wherein the amino acid substitutions are T366S, L368A, and/or Y407V.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution(s) at positions corresponding to positions 366, 368, and/or 407 and of human IgG1 or IgG4 according to EU Index, wherein the amino acid substitutions are T366S, L368A, and/or Y407V; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution at position corresponding to position 366 of human IgG1 or IgG4 according to EU Index, wherein the amino acid substitution is T366W.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitutions at positions corresponding to positions 354 and 366 of human IgG1 or IgG4 according to EU Index, wherein the amino acid substitutions are S354C and T366W; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitutions at positions corresponding to positions 349, 366, 368, and 407 of human IgG1 or IgG4 according to EU Index, wherein the amino acid substitutions are Y349C, T366S, L368A, and Y407V. In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitutions at positions corresponding to positions 349, 366, 368, and 407 of human IgG1 or IgG4 according to EU Index, wherein the amino acid substitutions are Y349C, T366S, L368A, and Y407V; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitutions at positions corresponding to positions 354 and 366 of human IgG1 or IgG4 according to EU Index, wherein the amino acid substitutions are S354C and T366W. In some embodiments, the first and/or second Fc regions are human IgG1 Fc regions. In some embodiments, the first and/or second Fc regions are human IgG4 Fc regions.

In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 354, 366, and 409 of human IgG4 according to EU Index, wherein the amino acid substitutions are S228P, S354C, T366W, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 349, 366, 368, 407, and 409 of human IgG4 according to EU Index, wherein the amino acid substitutions are S228P, Y349C, T366S, L368A, Y407V, and R409K. In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 349, 366, 368, 407, and 409 of human IgG4 according to EU Index, wherein the amino acid substitutions are S228P, Y349C, T366S, L368A, Y407V, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 354, 366, and 409 of human IgG4 according to EU Index, wherein the amino acid substitutions are S228P, S354C, T366W, and R409K.

In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 234, 235, 354, and 366 of human IgG4 according to EU Index, wherein the amino acid substitutions are F234A, L235A, S354C, and T366W; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 234, 235, 349, 366, 368, and 407 of human IgG4 according to EU Index, wherein the amino acid substitutions are F234A, L235A, Y349C, T366S, L368A, and Y407V. In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 234, 235, 349, 366, 368, and 407 of human IgG4 according to EU Index, wherein the amino acid substitutions are F234A, L235A, Y349C, T366S, L368A, and Y407V; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 234, 235, 354, and 366 of human IgG4 according to EU Index, wherein the amino acid substitutions are F234A, L235A, S354C, and T366W.

In some embodiments, a binding protein of the present disclosure comprises one or more mutations to reduce effector function, e.g., Fc receptor-mediated antibody-dependent cellular phagocytosis (ADCP), complement-dependent cytotoxicity (CDC), and/or antibody-dependent cellular cytotoxicity (ADCC). In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains; wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions are human IgG1 Fc regions; and wherein the first and the second Fc regions each comprise amino acid substitutions at positions corresponding to positions 234 and 235 of human IgG1 according to EU Index, wherein the amino acid substitutions are L234A and L235A. In some embodiments, the Fc regions of the second and the third polypeptide chains are human IgG1 Fc regions, and wherein the Fc regions each comprise amino acid substitutions at positions corresponding to positions 234 and 235 of human IgG1 according to EU Index, wherein the amino acid substitutions are L234A and L235A. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains; wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains;

wherein the first and second Fc regions are human IgG1 Fc regions; and wherein the first and the second Fc regions each comprise amino acid substitutions at positions corresponding to positions 234, 235, and 329 of human IgG1 according to EU Index, wherein the amino acid substitutions are L234A, L235A, and P329A. In some embodiments, the Fc regions of the second and the third polypeptide chains are human IgG1 Fc regions, and wherein the Fc regions each comprise amino acid substitutions at positions corresponding to positions 234, 235, and 329 of human IgG1 according to EU Index, wherein the amino acid substitutions are L234A, L235A, and P329A. In some embodiments, the Fc regions of the second and the third polypeptide chains are human IgG4 Fc regions, and the Fc regions each comprise amino acid substitutions at positions corresponding to positions 234 and 235 of human IgG4 according to EU Index, wherein the amino acid substitutions are F234A and L235A. In some embodiments, the binding protein comprises a second polypeptide chain further comprising a first Fc region linked to $C_{H1}$, the first Fc region comprising an immunoglobulin hinge region and $C_{H2}$ and $C_{H3}$ immunoglobulin heavy chain constant domains, and a third polypeptide chain further comprising a second Fc region linked to $C_{H1}$, the second Fc region comprising an immunoglobulin hinge region and $C_{H2}$ and $C_{H3}$ immunoglobulin heavy chain constant domains; and wherein the first and the second Fc regions each comprise amino acid substitutions at positions corresponding to positions 234 and 235 of human IgG4 according to EU Index, wherein the amino acid substitutions are F234A and L235A.

In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 234, 235, 354, 366, and 409 of human IgG4 according to EU Index, wherein the amino acid substitutions are S228P, F234A, L235A, S354C, T366W, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 234, 235, 349, 366, 368, 407, and 409 of human IgG4 according to EU Index, wherein the amino acid substitutions are S228P, F234A, L235A, Y349C, T366S, L368A, Y407V, and R409K. In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 234, 235, 349, 366, 368, 407, and 409 of human IgG4 according to EU Index, wherein the amino acid substitutions are S228P, F234A, L235A, Y349C, T366S, L368A, Y407V, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 234, 235, 354, 366, and 409 of human IgG4 according to EU Index, wherein the amino acid substitutions are S228P, F234A, L235A, S354C, T366W, and R409K.

In some embodiments, the Fc region is a human IgG4 Fc region comprising one or more mutations that reduce or eliminate FcγI and/or FcγII binding. In some embodiments, the Fc region is a human IgG4 Fc region comprising one or more mutations that reduce or eliminate FcγI and/or FcγII binding but do not affect FcRn binding. In some embodiments, the Fc region is a human IgG4 Fc region comprising amino acid substitutions at positions corresponding to positions 228 and/or 409 of human IgG4 according to EU Index. In some embodiments, the amino acid substitutions are S228P and/or R409K. In some embodiments, the Fc region is a human IgG4 Fc region comprising amino acid substitutions at positions corresponding to positions 234 and/or 235 of human IgG4 according to EU Index. In some embodiments, the amino acid substitutions are F234A and/or L235A. In some embodiments, the Fc region is a human IgG4 Fc region comprising amino acid substitutions at positions corresponding to positions 228, 234, 235, and/or 409 of human IgG4 according to EU Index. In some embodiments, the amino acid substitutions are S228P, F234A, L235A, and/or R409K. In some embodiments, the Fc region is a human IgG4 Fc region comprising amino acid substitutions at positions corresponding to positions 233-236 of human IgG4 according to EU Index. In some embodiments, the amino acid substitutions are E233P, F234V, L235A, and a deletion at 236. In some embodiments, the Fc region is a human IgG4 Fc region comprising amino acid mutations at substitutions corresponding to positions 228, 233-236, and/or 409 of human IgG4 according to EU Index. In some embodiments, the amino acid mutations are S228P; E233P, F234V, L235A, and a deletion at 236; and/or R409K.

In some embodiments, the Fc region comprises one or more mutations that reduce or eliminate Fc receptor binding and/or effector function of the Fc region (e.g., Fc receptor-mediated antibody-dependent cellular phagocytosis (ADCP), complement-dependent cytotoxicity (CDC), and/or antibody-dependent cellular cytotoxicity (ADCC)).

In some embodiments, the Fc region is a human IgG1 Fc region comprising one or more amino acid substitutions at positions corresponding to positions 234, 235, and/or 329 of human IgG1 according to EU Index. In some embodiments, the amino acid substitutions are L234A, L235A, and/or P329A. In some embodiments, the Fc region is a human IgG1 Fc region comprising amino acid substitutions at positions corresponding to positions 298, 299, and/or 300 of human IgG1 according to EU Index. In some embodiments, the amino acid substitutions are S298N, T299A, and/or Y300S.

In some embodiments, a binding protein of the present disclosure comprises one or more mutations to improve stability, e.g., of the hinge region and/or dimer interface of IgG4 (See e.g., Spiess, C. et al. (2013) *J. Biol. Chem.* 288:26583-26593). In some embodiments, the mutation comprises substitutions at positions corresponding to positions 228 and 409 of human IgG4 according to EU Index, wherein the amino acid substitutions are S228P and R409K. In some embodiments, the binding protein comprises a second polypeptide chain further comprising a first Fc region linked to $C_{H1}$, the first Fc region comprising an immunoglobulin hinge region and $C_{H2}$ and $C_{H3}$ immunoglobulin heavy chain constant domains, and a third polypeptide chain further comprising a second Fc region linked to $C_{H1}$, the second Fc region comprising an immunoglobulin hinge region and $C_{H2}$ and $C_{H3}$ immunoglobulin heavy chain constant domains; wherein the first and second Fc regions are human IgG4 Fc regions; and wherein the first and the second Fc regions each comprise amino acid substitutions at positions corresponding to positions 228 and 409 of human IgG4 according to EU Index, wherein the amino acid substitutions are S228P and R409K. In some embodiments, a binding protein of the present disclosure comprises knob and hole mutations and one or more mutations to improve stability. In some embodiments, the first and/or second Fc regions are human IgG4 Fc regions.

In some embodiments, the Fc region is a human IgG1 Fc region comprising one or more amino acid substitutions at positions corresponding to positions 234, 235, and/or 329 of human IgG1 according to EU Index. In some embodiments, the amino acid substitutions are L234A, L235A, and/or P329A. In some embodiments, the Fc region is a human IgG1 Fc region comprising amino acid substitutions at positions corresponding to positions 298, 299, and/or 300 of human IgG1 according to EU Index. In some embodiments, the amino acid substitutions are S298N, T299A, and/or Y300S.

Nucleic Acids

Other aspects of the present disclosure relate to isolated nucleic acid molecules comprising a nucleotide sequence encoding any of the binding proteins described herein. Exemplary and non-limiting nucleic acid sequences are provided in Table 5.

Other aspects of the present disclosure relate to kits of polynucleotides, e.g., that encode one or more polypeptides of a binding protein as described herein. In some embodiments, a kit of polynucleotides of the present disclosure comprises one, two, three, or four polynucleotides of a kit of polynucleotides comprising: (a) a first polynucleotide comprising the polynucleotide sequence of SEQ ID NO:189, a second polynucleotide comprising the polynucleotide sequence of SEQ ID NO:190, a third polynucleotide comprising the polynucleotide sequence of SEQ ID NO:191, and a fourth polynucleotide comprising the polynucleotide sequence of SEQ ID NO:192; (b) a first polynucleotide comprising the polynucleotide sequence of SEQ ID NO:193, a second polynucleotide comprising the polynucleotide sequence of SEQ ID NO:194, a third polynucleotide comprising the polynucleotide sequence of SEQ ID NO:195, and a fourth polynucleotide comprising the polynucleotide sequence of SEQ ID NO:196; (c) a first polynucleotide comprising the polynucleotide sequence of SEQ ID NO:197, a second polynucleotide comprising the polynucleotide sequence of SEQ ID NO:198, a third polynucleotide comprising the polynucleotide sequence of SEQ ID NO:199, and a fourth polynucleotide comprising the polynucleotide sequence of SEQ ID NO:200; (d) a first polynucleotide comprising the polynucleotide sequence of SEQ ID NO:201, a second polynucleotide comprising the polynucleotide sequence of SEQ ID NO:202, a third polynucleotide comprising the polynucleotide sequence of SEQ ID NO:203, and a fourth polynucleotide comprising the polynucleotide sequence of SEQ ID NO:204; (e) a first polynucleotide comprising the polynucleotide sequence of SEQ ID NO:205, a second polynucleotide comprising the polynucleotide sequence of SEQ ID NO:206, a third polynucleotide comprising the polynucleotide sequence of SEQ ID NO:207, and a fourth polynucleotide comprising the polynucleotide sequence of SEQ ID NO:208; (f) a first polynucleotide comprising the polynucleotide sequence of SEQ ID NO:209, a second polynucleotide comprising the polynucleotide sequence of SEQ ID NO:210, a third polynucleotide comprising the polynucleotide sequence of SEQ ID NO:211, and a fourth polynucleotide comprising the polynucleotide sequence of SEQ ID NO:212; (g) a first polynucleotide comprising the polynucleotide sequence of SEQ ID NO:213, a second polynucleotide comprising the polynucleotide sequence of SEQ ID NO:214, a third polynucleotide comprising the polynucleotide sequence of SEQ ID NO:215, and a fourth polynucleotide comprising the polynucleotide sequence of SEQ ID NO:216; (h) a first polynucleotide comprising the polynucleotide sequence of SEQ ID NO:217, a second polynucleotide comprising the polynucleotide sequence of SEQ ID NO:218, a third polynucleotide comprising the polynucleotide sequence of SEQ ID NO:219, and a fourth polynucleotide comprising the polynucleotide sequence of SEQ ID NO:220; (i) a first polynucleotide comprising the polynucleotide sequence of SEQ ID NO:221, a second polynucleotide comprising the polynucleotide sequence of SEQ ID NO:222, a third polynucleotide comprising the polynucleotide sequence of SEQ ID NO:223, and a fourth polynucleotide comprising the polynucleotide sequence of SEQ ID NO:224; (j) a first polynucleotide comprising the polynucleotide sequence of SEQ ID NO:225, a second polynucleotide comprising the polynucleotide sequence of SEQ ID NO:226, a third polynucleotide comprising the polynucleotide sequence of SEQ ID NO:227, and a fourth polynucleotide comprising the polynucleotide sequence of SEQ ID NO:228; (k) a first polynucleotide comprising the polynucleotide sequence of SEQ ID NO:229, a second polynucleotide comprising the polynucleotide sequence of SEQ ID NO:230, a third polynucleotide comprising the polynucleotide sequence of SEQ ID NO:231, and a fourth polynucleotide comprising the polynucleotide sequence of SEQ ID NO:232; (l) a first polynucleotide comprising the polynucleotide sequence of SEQ ID NO:233, a second polynucleotide comprising the polynucleotide sequence of SEQ ID NO:234, a third polynucleotide comprising the polynucleotide sequence of SEQ ID NO:235, and a fourth polynucleotide comprising the polynucleotide sequence of SEQ ID NO:236; (m) a first polynucleotide comprising the polynucleotide sequence of SEQ ID NO:237, a second polynucleotide comprising the polynucleotide sequence of SEQ ID NO:238, a third polynucleotide comprising the polynucleotide sequence of SEQ ID NO:239, and a fourth polynucleotide comprising the polynucleotide sequence of SEQ ID NO:240; (n) a first polynucleotide comprising the polynucleotide sequence of SEQ ID NO:241, a second polynucleotide comprising the polynucleotide sequence of SEQ ID NO:242, a third polynucleotide comprising the polynucleotide sequence of SEQ ID NO:243, and a fourth polynucleotide comprising the polynucleotide sequence of SEQ ID NO:244; (o) a first polynucleotide comprising the polynucleotide sequence of SEQ ID NO:245, a second polynucleotide comprising the polynucleotide sequence of SEQ ID NO:246, a third polynucleotide comprising the polynucleotide sequence of SEQ ID NO:247, and a fourth polynucleotide comprising the polynucleotide sequence of SEQ ID NO:248; (p) a first polynucleotide comprising the polynucleotide sequence of SEQ ID NO:249, a second polynucleotide comprising the polynucleotide sequence of SEQ ID NO:250, a third polynucleotide comprising the polynucleotide sequence of SEQ ID NO:251, and a fourth polynucleotide comprising the polynucleotide sequence of SEQ ID NO:252; (q) a first polynucleotide comprising the polynucleotide sequence of SEQ ID NO:253, a second polynucleotide comprising the polynucleotide sequence of SEQ ID NO:254, a third polynucleotide comprising the polynucleotide sequence of SEQ ID NO:255, and a fourth polynucleotide comprising the polynucleotide sequence of SEQ ID NO:256; (r) a first polynucleotide comprising the polynucleotide sequence of SEQ ID NO:257, a second polynucleotide comprising the polynucleotide sequence of SEQ ID NO:258, a third polynucleotide comprising the polynucleotide sequence of SEQ ID NO:259, and a fourth polynucleotide comprising the polynucleotide sequence of SEQ ID NO:260; (s) a first polynucleotide comprising the polynucleotide sequence of SEQ ID NO:261, a second polynucleotide comprising the polynucleotide sequence of SEQ ID NO:262, a third polynucleotide comprising the polynucleotide sequence of SEQ ID NO:263, and a fourth polynucleotide comprising the polynucleotide sequence of SEQ ID NO:264; (t) a first polynucleotide comprising the polynucleotide sequence of SEQ ID NO:265, a second polynucleotide comprising the polynucleotide sequence of SEQ ID NO:266, a third polynucleotide comprising the polynucleotide sequence of SEQ ID NO:267, and a fourth polynucleotide comprising the polynucleotide sequence of SEQ ID NO:268; (u) a first polynucleotide comprising the polynucleotide sequence of SEQ ID NO:269, a second polynucleotide comprising the polynucleotide sequence of SEQ ID NO:270, a third polynucleotide comprising the polynucleotide sequence of SEQ ID NO:271, and a fourth polynucleotide comprising the polynucleotide sequence of SEQ ID NO:272; or (v) a first polynucleotide comprising the polynucleotide sequence of SEQ ID NO:273, a second polynucleotide comprising the polynucleotide sequence of SEQ ID NO:274, a third polynucleotide comprising the polynucleotide sequence of SEQ ID NO:275, and a fourth polynucleotide comprising the polynucleotide sequence of SEQ ID NO:276.

Other aspects of the present disclosure relate to a vector system comprising one or more vectors encoding a first, second, third, and fourth polypeptide chain of any of the binding proteins described herein. In some embodiments, the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein, e.g., as shown in the polynucleotides of Table 6. In some embodiments, the vector system comprises a first vector encoding the first and second polypeptide chains of the binding protein, and a second vector encoding the third and fourth polypeptide chains of the binding protein. In some embodiments, the vector system comprises a first vector encoding the first and third polypeptide chains of the binding protein, and a second vector encoding the second and fourth polypeptide chains of the binding protein. In some embodiments, the vector system comprises a first vector encoding the first and fourth polypeptide chains of the binding protein, and a second vector encoding the second and third polypeptide chains of the binding protein. In some embodiments, the vector system comprises a first vector encoding the first, second, third, and fourth polypeptide chains of the binding protein. The one or more vectors of the vector system may be any of the vectors described herein. In some embodiments, the one or more vectors are expression vectors. In some embodiments, the first, second, third, and fourth polynucleotides are present on one or more expression vectors, e.g., one, two, three, or four expression vectors.

Standard recombinant DNA methodologies are used to construct the polynucleotides that encode the polypeptides which form the binding proteins, incorporate these polynucleotides into recombinant expression vectors, and introduce such vectors into host cells. See e.g., Sambrook et al., 2001, Molecular Cloning: a Laboratory Manual (Cold Spring Harbor Laboratory Press, 3rd ed.). Enzymatic reactions and purification techniques may be performed according to manufacturer's specifications, as commonly accomplished in the art, or as described herein. Unless specific definitions are provided, the nomenclature utilized in connection with, and the laboratory procedures and techniques of, analytical chemistry, synthetic organic chemistry, and medicinal and pharmaceutical chemistry described herein are those well-known and commonly used in the art. Similarly, conventional techniques may be used for chemical syntheses, chemical analyses, pharmaceutical preparation, formulation, delivery, and treatment of patients.

In some embodiments, the isolated nucleic acid is operably linked to a heterologous promoter to direct transcription of the binding protein-coding nucleic acid sequence. A promoter may refer to nucleic acid control sequences which direct transcription of a nucleic acid. A first nucleic acid sequence is operably linked to a second nucleic acid sequence when the first nucleic acid sequence is placed in a functional relationship with the second nucleic acid sequence. For instance, a promoter is operably linked to a coding sequence of a binding protein if the promoter affects the transcription or expression of the coding sequence. Examples of promoters may include, but are not limited to, promoters obtained from the genomes of viruses (such as polyoma virus, fowlpox virus, adenovirus (such as Adenovirus 2), bovine papilloma virus, avian sarcoma virus, cytomegalovirus, a retrovirus, hepatitis-B virus, Simian Virus 40 (SV40), and the like), from heterologous eukaryotic promoters (such as the actin promoter, an immunoglobulin promoter, from heat-shock promoters, and the like), the CAG-promoter (Niwa et al., Gene 108(2):193-9, 1991), the phosphoglycerate kinase (PGK)-promoter, a tetracycline-inducible promoter (Masui et al., Nucleic Acids Res. 33:e43, 2005), the lac system, the trp system, the tac system, the trc system, major operator and promoter regions of phage lambda, the promoter for 3-phosphoglycerate kinase, the promoters of yeast acid phosphatase, and the promoter of the yeast alpha-mating factors. Polynucleotides encoding binding proteins of the present disclosure may be under the control of a constitutive promoter, an inducible promoter, or any other suitable promoter described herein or other suitable promoter that will be readily recognized by one skilled in the art.

In some embodiments, the isolated nucleic acid is incorporated into a vector. In some embodiments, the vector is an expression vector. Expression vectors may include one or more regulatory sequences operatively linked to the polynucleotide to be expressed. The term "regulatory sequence" includes promoters, enhancers and other expression control elements (e.g., polyadenylation signals). Examples of suitable enhancers may include, but are not limited to, enhancer sequences from mammalian genes (such as globin, elastase, albumin, α-fetoprotein, insulin and the like), and enhancer sequences from a eukaryotic cell virus (such as SV40 enhancer on the late side of the replication origin (bp 100-270), the cytomegalovirus early promoter enhancer, the polyoma enhancer on the late side of the replication origin, adenovirus enhancers, and the like). Examples of suitable vectors may include, for example, plasmids, cosmids, episomes, transposons, and viral vectors (e.g., adenoviral, vaccinia viral, Sindbis-viral, measles, herpes viral, lentiviral, retroviral, adeno-associated viral vectors, etc.). Expression vectors can be used to transfect host cells, such as, for example, bacterial cells, yeast cells, insect cells, and mammalian cells. Biologically functional viral and plasmid DNA vectors capable of expression and replication in a host are known in the art, and can be used to transfect any cell of interest.

Host Cells

Other aspects of the present disclosure relate to a host cell (e.g., an isolated host cell) comprising one or more isolated polynucleotides, vectors, and/or vector systems described herein. In some embodiments, an isolated host cell of the present disclosure is cultured in vitro. In some embodiments, the host cell is a bacterial cell (e.g., an *E. coli* cell). In some embodiments, the host cell is a yeast cell (e.g., an *S. cerevisiae* cell). In some embodiments, the host cell is an insect cell. Examples of insect host cells may include, for example, *Drosophila* cells (e.g., S2 cells), *Trichoplusia ni* cells (e.g., High Five™ cells), and *Spodoptera frugiperda* cells (e.g., Sf21 or Sf9 cells). In some embodiments, the host cell is a mammalian cell. Examples of mammalian host cells may include, for example, human embryonic kidney cells (e.g., 293 or 293 cells subcloned for growth in suspension culture), Expi293™ cells, CHO cells, baby hamster kidney cells (e.g., BHK, ATCC CCL 10), mouse sertoli cells (e.g., TM4 cells), monkey kidney cells (e.g., CV1 ATCC CCL 70), African green monkey kidney cells (e.g., VERO-76, ATCC CRL-1587), human cervical carcinoma cells (e.g., HELA, ATCC CCL 2), canine kidney cells (e.g., MDCK, ATCC CCL 34), buffalo rat liver cells (e.g., BRL 3A, ATCC CRL 1442), human lung cells (e.g., W138, ATCC CCL 75), human liver cells (e.g., Hep G2, HB 8065), mouse mammary tumor cells (e.g., MMT 060562, ATCC CCL51), TRI cells, MRC 5 cells, FS4 cells, a human hepatoma line (e.g., Hep G2), and myeloma cells (e.g., NS0 and Sp2/0 cells).

Other aspects of the present disclosure relate to a method of producing any of the binding proteins described herein. In some embodiments, the method includes a) culturing a host cell (e.g., any of the host cells described herein) comprising an isolated nucleic acid, vector, and/or vector system (e.g., any of the isolated nucleic acids, vectors, and/or vector systems described herein) under conditions such that the host cell expresses the binding protein; and b) isolating the binding protein from the host cell. Methods of culturing host cells under conditions to express a protein are well known to one of ordinary skill in the art. Methods of isolating proteins from cultured host cells are well known to one of ordinary skill in the art, including, for example, by affinity chromatography (e.g., two step affinity chromatography comprising protein A affinity chromatography followed by size exclusion chromatography).

Pharmaceutical Compositions for Treating and/or Preventing Cancer

Therapeutic or pharmaceutical compositions comprising binding proteins are within the scope of the disclosure. Such therapeutic or pharmaceutical compositions can comprise a therapeutically effective amount of a binding protein, or binding protein-drug conjugate, in admixture with a pharmaceutically or physiologically acceptable formulation agent selected for suitability with the mode of administration.

Acceptable formulation materials are nontoxic to recipients at the dosages and concentrations employed.

The pharmaceutical composition can contain formulation materials for modifying, maintaining, or preserving, for example, the pH, osmolarity, viscosity, clarity, color, isotonicity, odor, sterility, stability, rate of dissolution or release, adsorption, or penetration of the composition. Suitable formulation materials include, but are not limited to, amino acids (such as glycine, glutamine, asparagine, arginine, or lysine), antimicrobials, antioxidants (such as ascorbic acid, sodium sulfite, or sodium hydrogen-sulfite), buffers (such as borate, bicarbonate, Tris-HCl, citrates, phosphates, or other organic acids), bulking agents (such as mannitol or glycine), chelating agents (such as ethylenediamine tetraacetic acid (EDTA)), complexing agents (such as caffeine, polyvinylpyrrolidone, beta-cyclodextrin, or hydroxypropyl-beta-cyclodextrin), fillers, monosaccharides, disaccharides, and other carbohydrates (such as glucose, mannose, or dextrins), proteins (such as serum albumin, gelatin, or immunoglobulins), coloring, flavoring and diluting agents, emulsifying agents, hydrophilic polymers (such as polyvinylpyrrolidone), low molecular weight polypeptides, salt-forming counterions (such as sodium), preservatives (such as benzalkonium chloride, benzoic acid, salicylic acid, thimerosal, phenethyl alcohol, methylparaben, propylparaben, chlorhexidine, sorbic acid, or hydrogen peroxide), solvents (such as glycerin, propylene glycol, or polyethylene glycol), sugar alcohols (such as mannitol or sorbitol), suspending agents, surfactants or wetting agents (such as pluronics; PEG; sorbitan esters; polysorbates such as polysorbate 20 or polysorbate 80; triton; tromethamine; lecithin; cholesterol or tyloxapal), stability enhancing agents (such as sucrose or sorbitol), tonicity enhancing agents (such as alkali metal halides—e.g., sodium or potassium chloride—or mannitol sorbitol), delivery vehicles, diluents, excipients and/or pharmaceutical adjuvants (see, e.g., Remington's Pharmaceutical Sciences (18th Ed., A. R. Gennaro, ed., Mack Publishing Company 1990), and subsequent editions of the same, incorporated herein by reference for any purpose).

The optimal pharmaceutical composition will be determined by a skilled artisan depending upon, for example, the intended route of administration, delivery format, and desired dosage. Such compositions can influence the physical state, stability, rate of in vivo release, and rate of in vivo clearance of the binding protein.

The primary vehicle or carrier in a pharmaceutical composition can be either aqueous or non-aqueous in nature. For example, a suitable vehicle or carrier for injection can be water, physiological saline solution, or artificial cerebrospinal fluid, possibly supplemented with other materials common in compositions for parenteral administration. Neutral buffered saline or saline mixed with serum albumin are further exemplary vehicles. Other exemplary pharmaceutical compositions comprise Tris buffer of about pH 7.0-8.5, or acetate buffer of about pH 4.0-5.5, which can further include sorbitol or a suitable substitute. In one embodiment of the disclosure, binding protein compositions can be prepared for storage by mixing the selected composition having the desired degree of purity with optional formulation agents in the form of a lyophilized cake or an aqueous solution. Further, the binding protein can be formulated as a lyophilizate using appropriate excipients such as sucrose.

The pharmaceutical compositions of the disclosure can be selected for parenteral delivery or subcutaneous. Alternatively, the compositions can be selected for inhalation or for delivery through the digestive tract, such as orally. The preparation of such pharmaceutically acceptable compositions is within the skill of the art.

The formulation components are present in concentrations that are acceptable to the site of administration. For example, buffers are used to maintain the composition at physiological pH or at a slightly lower pH, typically within a pH range of from about 5 to about 8.

When parenteral administration is contemplated, the therapeutic compositions for use can be in the form of a pyrogen-free, parenterally acceptable, aqueous solution comprising the desired binding protein in a pharmaceutically acceptable vehicle. A particularly suitable vehicle for parenteral injection is sterile distilled water in which a binding protein is formulated as a sterile, isotonic solution, properly preserved. Yet another preparation can involve the formulation of the desired molecule with an agent, such as injectable microspheres, bio-erodible particles, polymeric compounds (such as polylactic acid or polyglycolic acid), beads, or liposomes, that provides for the controlled or sustained release of the product which can then be delivered via a depot injection. Hyaluronic acid can also be used, and this can have the effect of promoting sustained duration in the circulation. Other suitable means for the introduction of the desired molecule include implantable drug delivery devices.

In one embodiment, a pharmaceutical composition can be formulated for inhalation. For example, a binding protein can be formulated as a dry powder for inhalation. Binding protein inhalation solutions can also be formulated with a propellant for aerosol delivery. In yet another embodiment, solutions can be nebulized.

It is also contemplated that certain formulations can be administered orally. In one embodiment of the disclosure, binding proteins that are administered in this fashion can be formulated with or without those carriers customarily used in the compounding of solid dosage forms such as tablets and capsules. For example, a capsule can be designed to release the active portion of the formulation at the point in the gastrointestinal tract where bioavailability is maximized and pre-systemic degradation is minimized. Additional agents can be included to facilitate absorption of the binding protein. Diluents, flavorings, low melting point waxes, vegetable oils, lubricants, suspending agents, tablet disintegrating agents, and binders can also be employed.

Another pharmaceutical composition can involve an effective quantity of binding proteins in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions of the disclosure will be evident to those skilled in the art, including formulations involving binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. Additional examples of sustained-release preparations include semipermeable polymer matrices in the form of shaped articles, e.g. films, or microcapsules. Sustained release matrices can include polyesters, hydrogels, polylactides, copolymers of L-glutamic acid and gamma ethyl-L-glutamate, poly(2-hydroxyethyl-methacrylate), ethylene vinyl acetate, or poly-D(−)-3-hydroxybutyric acid. Sustained-release compositions can also include liposomes, which can be prepared by any of several methods known in the art.

Pharmaceutical compositions to be used for in vivo administration typically must be sterile. This can be accomplished by filtration through sterile filtration membranes. Where the composition is lyophilized, sterilization using this method can be conducted either prior to, or following, lyophilization and reconstitution. The composition for parenteral administration can be stored in lyophilized form or in a solution. In addition, parenteral compositions generally are placed into a container having a sterile access port, for example, an intravenous solution bag or vial having a stopper pierceable by a hypodermic injection needle.

Once the pharmaceutical composition has been formulated, it can be stored in sterile vials as a solution, suspension, gel, emulsion, solid, or as a dehydrated or lyophilized powder. Such formulations can be stored either in a ready-to-use form or in a form (e.g., lyophilized) requiring reconstitution prior to administration.

The disclosure also encompasses kits for producing a single-dose administration unit. The kits can each contain both a first container having a dried protein and a second container having an aqueous formulation. Also included within the scope of this disclosure are kits containing single and multi-chambered pre-filled syringes (e.g., liquid syringes and lyosyringes).

The effective amount of a binding protein pharmaceutical composition to be employed therapeutically will depend, for example, upon the therapeutic context and objectives. One skilled in the art will appreciate that the appropriate dosage levels for treatment will thus vary depending, in part, upon the molecule delivered, the indication for which the binding protein is being used, the route of administration, and the size (body weight, body surface, or organ size) and condition (the age and general health) of the patient. Accordingly, the clinician can titer the dosage and modify the route of administration to obtain the optimal therapeutic effect.

Dosing frequency will depend upon the pharmacokinetic parameters of the binding protein in the formulation being used. Typically, a clinician will administer the composition until a dosage is reached that achieves the desired effect. The composition can therefore be administered as a single dose, as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages can be ascertained through use of appropriate dose-response data.

The route of administration of the pharmaceutical composition is in accord with known methods, e.g., orally; through injection by intravenous, intraperitoneal, intracerebral (intraparenchymal), intracerebroventricular, intramuscular, intraocular, intraarterial, intraportal, or intralesional routes; by sustained release systems; or by implantation devices. Where desired, the compositions can be administered by bolus injection or continuously by infusion, or by implantation device.

The composition can also be administered locally via implantation of a membrane, sponge, or other appropriate material onto which the desired molecule has been absorbed or encapsulated. Where an implantation device is used, the device can be implanted into any suitable tissue or organ, and delivery of the desired molecule can be via diffusion, timed-release bolus, or continuous administration.

The pharmaceutical compositions can be used to prevent and/or treat HIV infection. The pharmaceutical compositions can be used as a standalone therapy or in combination with standard anti-retroviral therapy.

The disclosure also relates to a kit comprising a binding protein and other reagents useful for detecting target antigen levels in biological samples. Such reagents can include a detectable label, blocking serum, positive and negative control samples, and detection reagents. In some embodiments, the kit comprises a composition comprising any binding protein, polynucleotide, vector, vector system, and/or host cell described herein. In some embodiments, the kit comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing a condition (e.g., HIV infection) and may have a sterile access port (for example the container may be an intravenous solution bag or a vial having a stopper pierceable by a hypodermic injection needle). In some embodiments, the label or package insert indicates that the composition is used for preventing, diagnosing, and/or treating the condition of choice. Alternatively, or additionally, the article of manufacture or kit may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

Methods and Uses for Binding Proteins

Virus

Certain aspects of the present disclosure relate to methods for expanding virus-specific memory T cells. In some embodiments, the methods comprise contacting a virus-specific memory T cell with a binding protein of the present disclosure, e.g., a trispecific binding protein that comprises a first antigen binding site that binds a CD28 polypeptide, a second antigen binding site that binds a CD3 polypeptide, and a third antigen binding site that binds a CD38 polypeptide.

In some embodiments, the virus-specific memory T cell is contacted with the binding protein in vitro or ex vivo.

In some embodiments, contacting the virus-specific memory T cell with the binding protein causes activation and/or proliferation of virus-specific memory T cells.

Other aspects of the present disclosure relate to methods for expanding T cells. In some embodiments, the methods comprise contacting a T cell with a binding protein of the present disclosure, e.g., a trispecific binding protein that comprises a first antigen binding site that binds a CD28 polypeptide, a second antigen binding site that binds a CD3 polypeptide, and a third antigen binding site that binds a CD38 polypeptide.

In some embodiments, the T cell is a memory T cell or an effector T cell.

In some embodiments, the T cell expresses a chimeric antigen receptor (CAR) on its cell surface or comprises a polynucleotide encoding a CAR.

Other aspects of the present disclosure relate to methods for treating chronic viral infection, e.g., in an individual in need thereof. In some embodiments, the methods comprise administering to an individual in need thereof an effective amount of a binding protein of the present disclosure, e.g., a trispecific binding protein that comprises a first antigen binding site that binds a CD28 polypeptide, a second antigen binding site that binds a CD3 polypeptide, and a third antigen binding site that binds a CD38 polypeptide.

In some embodiments, the individual is a human.

In some embodiments, the binding protein is administered to the individual in pharmaceutical formulation comprising the binding protein and a pharmaceutically acceptable carrier.

In some embodiments, administration of the binding protein results in activation and/or proliferation of virus-specific memory T cells in the individual.

In any of the above methods, memory T cells can be CD8+ or CD4+ memory T cells. In any of the above methods, memory T cells can be central memory T cells ($T_{CM}$) or effector memory T cells ($T_{EM}$).

Cancer

Certain aspects of the present disclosure relate to methods for preventing and/or treating cancer in a patient. In some embodiments, the methods comprise administering to the patient a therapeutically effective amount of a binding protein or pharmaceutical composition of the present disclosure.

In some embodiments, a binding protein of the present disclosure is administered to a patient in need thereof for the treatment or prevention of cancer. In some embodiments, the present disclosure relates to a method of preventing and/or treating a proliferative disease or disorder (e.g., cancer). In some embodiments, the method comprises administering to a patient a therapeutically effective amount of at least one of the binding proteins, or pharmaceutical compositions related thereto, described herein. In some embodiments, the present disclosure relates to uses of at least one of the binding proteins, or pharmaceutical compositions related thereto, described herein for preventing and/or treating a proliferative disease or disorder (e.g., cancer) in a patient in need thereof. In some embodiments, the present disclosure relates to at least one of the binding proteins, or pharmaceutical compositions related thereto, described herein for use in the manufacture of a medicament for preventing and/or treating a proliferative disease or disorder (e.g., cancer) in a patient in need thereof. In some embodiments, the patient is a human.

In some embodiments, the at least one binding protein is administered (or is to be administered) in combination with one or more anti-cancer therapies (e.g., any anti-cancer therapy known in the art, such as a chemotherapeutic agent or therapy). In some embodiments, the at least one binding protein is administered (or is to be administered) before the one or more anti-cancer therapies. In some embodiments, the at least one binding protein is administered (or is to be administered) concurrently with the one or more anti-cancer therapies. In some embodiments, the at least one binding protein is administered (or is to be administered) after the one or more anti-cancer therapies.

In some embodiments, the binding protein comprises one or two antigen binding site(s) that binds a T-cell surface protein and another antigen binding site that binds the extracellular domain of a human HER2 polypeptide. In some embodiments, the binding protein comprises an antigen binding site that binds the extracellular domain of a human HER2 polypeptide, an antigen binding site that binds a human CD28 polypeptide, and an antigen binding site that binds a human CD3 polypeptide.

In some embodiments, cancer cells from the individual express HER2. In some embodiments, the patient is selected for treatment on the basis that the cells of the cancer express a human HER2 polypeptide. Assays known in the art suitable for detecting HER2 expression by cancer cells include, without limitation, immunohistochemical (IHC) and fluorescence in situ hybridization (FISH) assays.

In some embodiments, the cancer (e.g., HER2-positive cancer) is breast cancer, colorectal cancer, gastric cancer, or non-small cell lung cancer (NSCLC).

In some embodiments, the binding protein comprises one or two antigen binding site(s) that binds a T-cell surface protein and another antigen binding site that binds the extracellular domain of a human CD38 polypeptide. In some embodiments, the binding protein comprises an antigen binding site that binds the extracellular domain of a human CD38 polypeptide, an antigen binding site that binds a human CD28 polypeptide, and an antigen binding site that binds a human CD3 polypeptide.

In some embodiments, cancer cells from the individual express CD38. In some embodiments, cells of the cancer express a human CD38 isoform A polypeptide on their cell surface. In some embodiments, cells of the cancer express a human CD38 isoform E polypeptide on their cell surface. In some embodiments, the patient is selected for treatment on the basis that the cells of the cancer express a human CD38 isoform E polypeptide on their cell surface. In some embodiments, the cancer cells express CD38 and CD28. In some embodiments, the cancer cells express CD38 and do not express CD28.

In some embodiments, the cancer (e.g., CD38-positive cancer) is multiple myeloma, acute lymphoblastic leukemia, chronic lymphocytic leukemia, acute myeloid leukemia, lymphoma, breast cancer such as Her2+ breast cancer, prostate cancer, germinal center B-cell lympohoma or B-cell acute lymphoblastic leukemia. In certain embodiments, the cancer is multiple myeloma. In certain embodiments, the cancer is acute myeloid leukemia (AML), acute lymphoblastic leukemia (ALL), chronic lymphocytic leukemia (CLL), or a B cell lymphoma.

In certain embodiments, the cancer is multiple myeloma. Anti-CD38 antibodies have been tested for the treatment of multiple myeloma, such as daratumumab. However, while multiple myeloma is considered treatable, relapse is inevitable in almost all patients, leading to the development of treatment-refractory disease. In some embodiments, the cancer is relapsed or refractory multiple myeloma. In some embodiments, the patient has been treated with a prior multiple myeloma treatment. In some embodiments, a binding protein of the present disclosure is administered to the patient as a $1^{st}$, $2^{nd}$ or $3^{rd}$ line treatment for multiple myeloma. Without wishing to be bound to theory, it is thought that an anti-CD38×anti-CD28×anti-CD3 binding protein of the present disclosure may be useful in treating multiple myeloma, e.g., by recruiting T cells to tumor cells via anti-CD38 (or anti-CD28/anti-CD38), activation of engaged T cells via anti-CD3/anti-CD28, and/or killing of tumor cells through perforin/granzyme-based mechanisms. CD28 has been reported as a novel cancer marker for multiple myeloma. See Nair, J. R. et al. (2011) *J. Immunol.* 187:1243-1253.

Any of the binding proteins described herein may find use in the methods of the present disclosure.

In some embodiments of any of the methods of the present disclosure, prior to administration of the binding protein, the patient has been treated with daratumumab. As described herein, the present disclosure provides anti-CD38 binding proteins and sites that do not compete for binding CD38 with daratumumab. Without wishing to be bound to theory, it is thought that this is advantageous because a patient previously treated with daratumumab can be treated with a binding protein of the present disclosure, e.g., without a wash-out period prior to treatment.

The binding proteins can be employed in any known assay method, such as competitive binding assays, direct and indirect sandwich assays, and immunoprecipitation assays for the detection and quantitation of one or more target antigens. The binding proteins will bind the one or more target antigens with an affinity that is appropriate for the assay method being employed.

For diagnostic applications, in certain embodiments, binding proteins can be labeled with a detectable moiety. The detectable moiety can be any one that is capable of producing, either directly or indirectly, a detectable signal. For example, the detectable moiety can be a radioisotope, such as $^{3}H$, $^{14}C$, $^{32}P$, $^{35}S$, $^{125}I$, $^{99}Tc$, $^{111}In$, or $^{67}Ga$; a fluorescent or chemiluminescent compound, such as fluorescein isothiocyanate, rhodamine, or luciferin; or an enzyme, such as alkaline phosphatase, β-galactosidase, or horseradish peroxidase.

The binding proteins are also useful for in vivo imaging. A binding protein labeled with a detectable moiety can be administered to an animal, preferably into the bloodstream, and the presence and location of the labeled antibody in the host assayed. The binding protein can be labeled with any moiety that is detectable in an animal, whether by nuclear magnetic resonance, radiology, or other detection means known in the art.

For clinical or research applications, in certain embodiments, binding proteins can be conjugated to a cytotoxic agent. A variety of antibodies coupled to cytotoxic agents (i.e., antibody-drug conjugates) have been used to target cytotoxic payloads to specific tumor cells. Cytotoxic agents and linkers that conjugate the agents to an antibody are known in the art; see, e.g., Parslow, A. C. et al. (2016) *Biomedicines* 4:14 and Kalim, M. et al. (2017) *Drug Des. Devel. Ther.* 11:2265-2276.

Binding Protein Therapeutic Compositions and Administration Thereof for Treating and/or Preventing Cancer Therapeutic or pharmaceutical compositions comprising binding proteins are within the scope of the disclosure. Such therapeutic or pharmaceutical compositions can comprise a therapeutically effective amount of a binding protein, or binding protein-drug conjugate, in admixture with a pharmaceutically or physiologically acceptable formulation agent selected for suitability with the mode of administration. These pharmaceutical compositions may find use in any of the methods and uses described herein (e.g., ex vivo, in vitro, and/or in vivo).

Acceptable formulation materials preferably are nontoxic to recipients at the dosages and concentrations employed.

The pharmaceutical composition can contain formulation materials for modifying, maintaining, or preserving, for example, the pH, osmolarity, viscosity, clarity, color, isotonicity, odor, sterility, stability, rate of dissolution or release, adsorption, or penetration of the composition. Suitable formulation materials include, but are not limited to, amino acids (such as glycine, glutamine, asparagine, arginine, or lysine), antimicrobials, antioxidants (such as ascorbic acid, sodium sulfite, or sodium hydrogen-sulfite), buffers (such as borate, bicarbonate, Tris-HCl, citrates, phosphates, or other organic acids), bulking agents (such as mannitol or glycine), chelating agents (such as ethylenediamine tetraacetic acid (EDTA)), complexing agents (such as caffeine, polyvinylpyrrolidone, beta-cyclodextrin, or hydroxypropyl-beta-cyclodextrin), fillers, monosaccharides, disaccharides, and other carbohydrates (such as glucose, mannose, or dextrins), proteins (such as serum albumin, gelatin, or immunoglobulins), coloring, flavoring and diluting agents, emulsifying agents, hydrophilic polymers (such as polyvinylpyrrolidone), low molecular weight polypeptides, salt-forming counterions (such as sodium), preservatives (such as benzalkonium chloride, benzoic acid, salicylic acid, thimerosal, phenethyl alcohol, methylparaben, propylparaben, chlorhexidine, sorbic acid, or hydrogen peroxide), solvents (such as glycerin, propylene glycol, or polyethylene glycol), sugar alcohols (such as mannitol or sorbitol), suspending agents, surfactants or wetting agents (such as pluronics; PEG; sorbitan esters; polysorbates such as polysorbate 20 or polysorbate 80; triton; tromethamine; lecithin; cholesterol or tyloxapal), stability enhancing agents (such as sucrose or sorbitol), tonicity enhancing agents (such as alkali metal halides—preferably sodium or potassium chloride—or mannitol sorbitol), delivery vehicles, diluents, excipients and/or pharmaceutical adjuvants (see, e.g., Remington's Pharmaceutical Sciences (18th Ed., A. R. Gennaro, ed., Mack Publishing Company 1990), and subsequent editions of the same, incorporated herein by reference for any purpose).

The optimal pharmaceutical composition will be determined by a skilled artisan depending upon, for example, the intended route of administration, delivery format, and desired dosage. Such compositions can influence the physical state, stability, rate of in vivo release, and rate of in vivo clearance of the binding protein.

The primary vehicle or carrier in a pharmaceutical composition can be either aqueous or non-aqueous in nature. For example, a suitable vehicle or carrier for injection can be water, physiological saline solution, or artificial cerebrospinal fluid, possibly supplemented with other materials common in compositions for parenteral administration. Neutral buffered saline or saline mixed with serum albumin are further exemplary vehicles. Other exemplary pharmaceutical compositions comprise Tris buffer of about pH 7.0-8.5, or acetate buffer of about pH 4.0-5.5, which can further include sorbitol or a suitable substitute. In one embodiment of the disclosure, binding protein compositions can be prepared for storage by mixing the selected composition having the desired degree of purity with optional formulation agents in the form of a lyophilized cake or an aqueous solution. Further, the binding protein can be formulated as a lyophilizate using appropriate excipients such as sucrose.

The pharmaceutical compositions of the disclosure can be selected for parenteral delivery or subcutaneous. Alternatively, the compositions can be selected for inhalation or for delivery through the digestive tract, such as orally. The preparation of such pharmaceutically acceptable compositions is within the skill of the art.

The formulation components are present in concentrations that are acceptable to the site of administration. For example, buffers are used to maintain the composition at physiological pH or at a slightly lower pH, typically within a pH range of from about 5 to about 8.

When parenteral administration is contemplated, the therapeutic compositions for use can be in the form of a pyrogen-free, parenterally acceptable, aqueous solution comprising the desired binding protein in a pharmaceutically acceptable vehicle. A particularly suitable vehicle for parenteral injection is sterile distilled water in which a binding protein is formulated as a sterile, isotonic solution, properly preserved. Yet another preparation can involve the formulation of the desired molecule with an agent, such as injectable microspheres, bio-erodible particles, polymeric compounds (such as polylactic acid or polyglycolic acid), beads, or liposomes, that provides for the controlled or sustained release of the product which can then be delivered via a depot injection. Hyaluronic acid can also be used, and this can have the effect of promoting sustained duration in the circulation. Other suitable means for the introduction of the desired molecule include implantable drug delivery devices.

In one embodiment, a pharmaceutical composition can be formulated for inhalation. For example, a binding protein can be formulated as a dry powder for inhalation. Binding protein inhalation solutions can also be formulated with a propellant for aerosol delivery. In yet another embodiment, solutions can be nebulized.

It is also contemplated that certain formulations can be administered orally. In one embodiment of the disclosure, binding proteins that are administered in this fashion can be formulated with or without those carriers customarily used in the compounding of solid dosage forms such as tablets and capsules. For example, a capsule can be designed to release the active portion of the formulation at the point in the gastrointestinal tract when bioavailability is maximized and pre-systemic degradation is minimized. Additional agents can be included to facilitate absorption of the binding protein. Diluents, flavorings, low melting point waxes, vegetable oils, lubricants, suspending agents, tablet disintegrating agents, and binders can also be employed.

Another pharmaceutical composition can involve an effective quantity of binding proteins in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions of the disclosure will be evident to those skilled in the art, including formulations involving binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. Additional examples of sustained-release preparations include semipermeable polymer matrices in the form of shaped articles, e.g. films, or microcapsules. Sustained release matrices can include polyesters, hydrogels, polylactides, copolymers of L-glutamic acid and gamma ethyl-L-glutamate, poly(2-hydroxyethyl-methacrylate), ethylene vinyl acetate, or poly-D(−)-3-hydroxybutyric acid. Sustained-release compositions can also include liposomes, which can be prepared by any of several methods known in the art.

Pharmaceutical compositions to be used for in vivo administration typically must be sterile. This can be accomplished by filtration through sterile filtration membranes. Where the composition is lyophilized, sterilization using this method can be conducted either prior to, or following, lyophilization and reconstitution. The composition for parenteral administration can be stored in lyophilized form or in a solution. In addition, parenteral compositions generally are placed into a container having a sterile access port, for example, an intravenous solution bag or vial having a stopper pierceable by a hypodermic injection needle.

Once the pharmaceutical composition has been formulated, it can be stored in sterile vials as a solution, suspension, gel, emulsion, solid, or as a dehydrated or lyophilized powder. Such formulations can be stored either in a ready-to-use form or in a form (e.g., lyophilized) requiring reconstitution prior to administration.

The disclosure also relates to a kit comprising a binding protein and other reagents useful for detecting target antigen levels in biological samples. Such reagents can include a detectable label, blocking serum, positive and negative control samples, and detection reagents. In some embodiments, the kit comprises a composition comprising any binding protein, polynucleotide, vector, vector system, and/or host cell described herein. In some embodiments, the kit comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing a condition and may have a sterile access port (for example the container may be an intravenous solution bag or a vial having a stopper pierceable by a hypodermic injection needle). In some embodiments, the label or package insert indicates that the composition is used for preventing, diagnosing, and/or treating the condition of choice. Alternatively, or additionally, the article of manufacture or kit may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

The disclosure also encompasses kits for producing a single-dose administration unit. The kits can each contain both a first container having a dried protein and a second container having an aqueous formulation. Also included within the scope of this disclosure are kits containing single and multi-chambered pre-filled syringes (e.g., liquid syringes and lyosyringes).

The effective amount of a binding protein pharmaceutical composition to be employed therapeutically will depend, for example, upon the therapeutic context and objectives. One skilled in the art will appreciate that the appropriate dosage levels for treatment will thus vary depending, in part, upon the molecule delivered, the indication for which the binding protein is being used, the route of administration, and the size (body weight, body surface, or organ size) and condition (the age and general health) of the patient. Accordingly, the clinician can titer the dosage and modify the route of administration to obtain the optimal therapeutic effect.

Dosing frequency will depend upon the pharmacokinetic parameters of the binding protein in the formulation being used. Typically, a clinician will administer the composition until a dosage is reached that achieves the desired effect. The composition can therefore be administered as a single dose, as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages can be ascertained through use of appropriate dose-response data.

The route of administration of the pharmaceutical composition is in accord with known methods, e.g., orally; through injection by intravenous, intraperitoneal, intracerebral (intraparenchymal), intracerebroventricular, intramuscular, intraocular, intraarterial, intraportal, or intralesional routes; by sustained release systems; or by implantation devices. Where desired, the compositions can be administered by bolus injection or continuously by infusion, or by implantation device.

The composition can also be administered locally via implantation of a membrane, sponge, or other appropriate material onto which the desired molecule has been absorbed or encapsulated. Where an implantation device is used, the device can be implanted into any suitable tissue or organ, and delivery of the desired molecule can be via diffusion, timed-release bolus, or continuous administration.

TABLE 1

Trispecific binding protein polypeptide sequences

| Molecule | Polypeptide Number (acc. to formula) | SEQ ID NO | Sequence |
|---|---|---|---|
| HER2 (WT-trastuzumab)/CD28supxCD3mid (32/35 QQ (LC); DKTHT linkers on HC/LC) IgG4 FALA BP # 1 | 1 | 100 | DIVMTQTPLSLSVTPGQPASISCKSSQSLVHQNAQTYLSWYLQKPGQSPQSLIYKVSNRFSGVPDRFSGSGSG TDFTLKISRVEAEDVGVYYCGQGTQYPFTFGSGTKVEIKDKTHTDIQMTQSPSSLSASVGDRVTITCQASQNI YVWLNWYQQKPGKAPKLLIYKASNLHTGVPSRFSGSGSGTDFTLTISSLQPEDIATYYCQQGQTYPYTFGQG TKLEIKDKTHTRTVAAPSVFIFPPSDEQLKSGTASVVCLLNNFYPREAKVQWKVDNALQSGNSQESVTEQDS KDSTYSLSSTLTLSKADYEKHKVYACEVTHQGLSSPVTKSFNRGEC |
| | 2 | 101 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSDKTHTQVQLVESGGGVVQPG RSLRLSCAASGFTFTKAWMHWVRQAPGKQLEWVAQIKDKSNSYATYYADSVKGRFTISRDDSKNTLYLQM NSLRAEDTAVYYCRGVYYALSPFDYWGQGTLVTVSSDKTHTASTKGPSVFPLAPCSRSTSESTAALGCLVK DYFPEPVTVSWNSGALTSGVHTFPAVLQSSGLYSLSSVVTVPSSSLGTKTYTCNVDHKPSNTKVDKRVESKY GPPCPPCPAPEAAGGPSVFLFPPKPKDTLMISRTPEVTCVVVDVSQEDPEVQFNWYVDGVEVHNAKTKPREE QFNSTYRVVSVLTVLHQDWLNGKEYKCKVSNKGLPSSIEKTISKAKGQPREPQVCTLPPSQEEMTKNQVSLS CAVKGFYPSDIAVEWESNGQPENNYKTTPPVLDSDGSFFLVSKLTVDKSRWQEGNVFSCSVMHEALHNHYT QKSLSLSLG |
| | 3 | 102 | EVQLVESGGGLVQPGGSLRLSCAASGFNIKDTYIHWVRQAPGKGLEWVARIYPTNGYTRYADSVKGRFTIS ADTSKNTAYLQMNSLRAEDTAVYYCSRWGGDGFYAMDYWGQGTLVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEAAGGPSVFLFPPKPKDTLMISRTPEVTCVVVDVSQEDPEVQFNWYVDGVEV HNAKTKPREEQFNSTYRVVSVLTVLHQDWLNGKEYKCKVSNKGLPSSIEKTISKAKGQPREPQVYTLPPCQE EMTKNQVSLWCLVKGFYPSDIAVEWESNGQPENNYKTTPPVLDSDGSFFLYSKLTVDKSRWQEGNVFSCSV MHEALHNHYTQKSLSLSLG |

TABLE 1-continued

| Trispecific binding protein polypeptide sequences | | | |
|---|---|---|---|
| Molecule | Poly-peptide Number (acc. to formula) | SEQ ID NO | Sequence |
| | 4 | 103 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| HER2 (30R/55Q/102E + LC-WT-trastuzumab)/ CD28supxCD3mid (32/35 QQ (LC); DKTHT linkers on HC/LC) IgG4 FALA BP # 2 | 1 | 104 | DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 105 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 106 | EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGEGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 107 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| HER2 (30R/55Q/102E + LC-WT-trastuzumab)/ $CD28_{sup}xCD3_{mid}$ (DNAQ (LC); DKTHT linkers on HC/LC) IgG4 FALA BP # 8 | 1 | 108 | DIVMTQTPLSLSVTPGQPASISCKSSQSLVHDNAQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 109 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 110 | EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGEGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 111 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 1-continued

Trispecific binding protein polypeptide sequences

| Molecule | Polypeptide Number (acc. to formula) | SEQ ID NO | Sequence |
|---|---|---|---|
| HER2 (30R/56A/102S + LC-WT-trastuzumab)/ CD28supxCD3mid (32/35QQ185E) IgG4 FALA BP # 3 | 1 | 286 | DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 287 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 288 | EVQLVESGGGLVQPGGSLRLSCAASGFNIRDTYIHWVRQAPGKGLEWVARTYPTNAYTRYADSVKGRFTISADTSKNTAYLQMNSLRAEDTAVYYCSRWGGSGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 289 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| HER2 (30R/55Q/102E + LC-WT-trastuzumab)/ CD28supxCD3mid (32/35QQ185E) IgG4 FALA BP # 4 | 1 | 290 | DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIKGQPKAAPDIQMTQSPSSLSASVGDRVTITCQASQNIYVWLNWYQQKPGKAPKWYKASNLHTGVPSRFSGSGSGTDFTLTISSLQPEDIATYYCQQGQTYPYTFGQGTKLEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 291 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYAESVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 292 | EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGEGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 293 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| HER2 (30R/55Q/102E + LC-WT-trastuzumab)/ CD28supxCD3mid (32/35QQ185S) IgG4 FALA BP # 5 | 1 | 294 | DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIKGQPKAAPDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 1-continued

| Molecule | Poly-peptide Number (acc. to formula) | SEQ ID NO | Sequence |
|---|---|---|---|
| Trispecific binding protein polypeptide sequences | | | |
| | 2 | 295 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSSQVQLVESGGGVVQPGRSLR LSCAASGFTFTKAWMHWVRQAPGKQLEWVAQIKDKSNSYATYYASSVKGRFTISRDDSKNTLYLQMNSLR AEDTAVYYCRGVYYALSPFDYWGQGTLVTVSSRTASTKGPSVFPLAPCSRSTSESTAALGCLVKDYFPEPVT VSWNSGALTSGVHTFPAVLQSSGLYSLSSVVTVPSSSLGTKTYTCNVDHKPSNTKVDKRVESKYGPPCPPCP APEAAGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVCTLPPSQEEMTKNQVSLSCAVKGF YPSDIAVEWESNGQPENNYKTTPPVLDSDGSFFLVSKLTVDKSRWQEGNVFSCSVMHEALHNHYTQKSLSL SLG |
| | 3 | 296 | EVQLVESGGGLVQPGGSLRLSCAASGFNIRDTYIHWVRQAPGKGLEWVARIYPTQGYTRYADSVKGRFTIS ADTSKNTAYLQMNSLRAEDTAVYYCSRWGGEGFYAMDYWGQGTLVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEAAGGPSVFLFPPKPKDTLMISRTPEVTCVVVDVSQEDPEVQFNWYVDGVEV HNAKTKPREEQFNSTYRVVSVLTVLHQDWLNGKEYKCKVSNKGLPSSIEKTISKAKGQPREPQVYTLPPCQE EMTKNQVSLWCLVKGFYPSDIAVEWESNGQPENNYKTTPPVLDSDGSFFLYSKLTVDKSRWQEGNVFSCSV MHEALHNHYTQKSLSLSLG |
| | 4 | 297 | DIQMTQSPSSLSASVGDRVTITCRASQDVNTAVAWYQQKPGKAPKLLIYSASFLYSGVPSRFSGSRSGTDFTL TISSLQPEDFATYYCQQHYTTPPTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC |
| HER2 (30R/55Q/102E + LC-WT-trastuzumab)/ CD28supxCD3mid (32/33/35QSQ 185S) IgG4 FALA BP # 6 | 1 | 298 | DIVMTQTPLSLSVTPGQPASISCKSSQSLVHQSAQTYLSWYLQKPGQSPQSLIYKVSNRFSGVPDRFSGSGSGT DFTLKISRVEAEDVGVYYCGQGTQYPFTFGSGTKVEIKGQPKAAPDIQMTQSPSSLSASVGDRVTITCQASQN IYVWLNWYQQKPGKAPKLLIYKASNLHTGVPSRFSGSGSGTDFTLTISSLQPEDIATYYCQQGQTYPYTFGQ GTKLEIKTKGPSRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| | 2 | 299 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSSQVQLVESGGGVVQPGRSLR LSCAASGFTFTKAWMHWVRQAPGKQLEWVAQIKDKSNSYATYYASSVKGRFTISRDDSKNTLYLQMNSLR AEDTAVYYCRGVYYALSPFDYWGQGTLVTVSSRTASTKGPSVFPLAPCSRSTSESTAALGCLVKDYFPEPVT VSWNSGALTSGVHTFPAVLQSSGLYSLSSVVTVPSSSLGTKTYTCNVDHKPSNTKVDKRVESKYGPPCPPCP APEAAGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVCTLPPSQEEMTKNQVSLSCAVKGF YPSDIAVEWESNGQPENNYKTTPPVLDSDGSFFLVSKLTVDKSRWQEGNVFSCSVMHEALHNHYTQKSLSL SLG |
| | 3 | 300 | EVQLVESGGGLVQPGGSLRLSCAASGFNIRDTYIHWVRQAPGKGLEWVARIYPTQGYTRYADSVKGRFTIS ADTSKNTAYLQMNSLRAEDTAVYYCSRWGGEGFYAMDYWGQGTLVTVSSASTKGPSVFPLAPCSRSTSES TAALGCLVKDYFPEPVTVSWNSGALTSGVHTFPAVLOSSGLYSLSSVVTVPSSSLGTKTYTCNVDHKPSNTK VDKRVESKYGPPCPPCPAPEAAGGPSVFLFPPKPKDTLMISRTPEVTCVVVDVSQEDPEVQFNWYVDGVEV HNAKTKPREEQFNSTYRVVSVLTVLHQDWLNGKEYKCKVSNKGLPSSIEKTISKAKGQPREPQVYTLPPCQE EMTKNQVSLWCLVKGFYPSDIAVEWESNGQPENNYKTTPPVLDSDGSFFLYSKLTVDKSRWQEGNVFSCSV MHEALHNHYTQKSLSLSLG |
| | 4 | 301 | DIQMTQSPSSLSASVGDRVTITCRASQDVNTAVAWYQQKPGKAPKLLIYSASFLYSGVPSRFSGSRSGTDFTL TISSLQPEDFATYYCQQHYTTPPTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC |
| HER2 (30R/550/102E + LC-WT-trastuzumab)/ CD28supxCD3mid (32/3500 (LC); L1 linker) IgG4 FALA BP # 9 | 1 | 112 | DIVMTQTPLSLSVTPGQPASISCKSSQSLVHQNAQTYLSWYLQKPGQSPQSLIYKVSNRFSGVPDRFSGSGSG TDFTLKISRVEAEDVGVYYCGQGTQYPFTFGSGTKVEIKGQPKAAPDIQMTQSPSSLSASVGDRVTITCQASQ NIYVWLNWYQQKPGKAPKLLIYKASNLHTGVPSRFSGSGSGTDFTLTISSLQPEDIATYYCQQGQTYPYTFG QGTKLEIKTKGPSRTVAAPSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | 2 | 113 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSSQVQLVESGGGVVQPGRSLR LSCAASGFTFTKAWMHWVRQAPGKQLEWVAQIKDKSNSYATYYADSVKGRFTISRDDSKNTLYLQMNSLR AEDTAVYYCRGVYYALSPFDYWGQGTLVTVSSRTASTKGPSVFPLAPCSRSTSESTAALGCLVKDYFPEPVT VSWNSGALTSGVHTFPAVLQSSGLYSLSSVVTVPSSSLGTKTYTCNVDHKPSNTKVDKRVESKYGPPCPPCP APEAAGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVCTLPPSQEEMTKNQVSLSCAVKGF |

TABLE 1-continued

Trispecific binding protein polypeptide sequences

| Molecule | Polypeptide Number (acc. to formula) | SEQ ID NO | Sequence |
| --- | --- | --- | --- |
| | | | YPSDIAVEWESNGQPENNYKTTPPVLDSDGSFFLVSKLTVDKSRWQEGNVFSCSVMHEALHNHYTQKSLSL SLG |
| | 3 | 114 | EVQLVESGGGLVQPGGSLRLSCAASGFNIRDTYIHWVRQAPGKGLEWVARIYPTQGYTRYADSVKGRFTIS ADTSKNTAYLQMNSLRAEDTAVYYCSRWGGEGFYAMDYWGQGTLVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEAAGGPSVFLFPPKPKDTLMISRTPEVTCVVVDVSQEDPEVQFNWYVDGVEV HNAKTKPREEQFNSTYRVVSVLTVLHQDWLNGKEYKCKVSNKGLPSSIEKTISKAKGQPREPQVYTLPPCQE EMTKNQVSLWCLVKGFYPSDIAVEWESNGQPENNYKTTPPVLDSDGSFFLYSKLTVDKSRWQEGNVFSCSV MHEALHNHYTQKSLSLSLG |
| | 4 | 115 | DIQMTQSPSSLSASVGDRVTITCRASQDVNTAVAWYQQKPGKAPKLLIYSASFLYSGVPSRFSGSRSGTDFTL TISSLQPEDFATYYCQQHYTTPPTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC |
| HER2-30R/ 55Q/102S + LC-WT-trastuzumab/ CD28supxCD3mid L1 linker IgG4 FALA BP # 10 | 1 | 116 | DIVMTQTPLSLSVTPGQPASISCKSSQSLVHNNANTYLSWYLQKPGQSPQSLIYKVSNRFSGVPDRFSGSGSG TDFTLKISRVEAEDVGVYYCGQGTQYPFTFGSGTKVEIKGQPKAAPDIQMTQSPSSLSASVGDRVTITCQASQ NIYVWLNWYQQKPGKAPKLLIYKASNLHTGVPSRFSGSGSGTDFTLTISSLQPEDIATYYCQQGQTYPYTFG QGTKLEIKTKGPSRTVAAPSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | 2 | 117 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSSQVQLVESGGGVVQPGRSLR LSCAASGFTFTKAWMHWVRQAPGKQLEWVAQIKDKSNSYATYYADSVKGRFTISRDDSKNTLYLQMNSLR AEDTAVYYCRGVYYALSPFDYWGQGTLVTVSSRTASTKGPSVFPLAPCSRSTSESTAALGCLVKDYFPEPVT VSWNSGALTSGVHTFPAVLQSSGLYSLSSVVTVPSSSLGTKTYTCNVDHKPSNTKVDKRVESKYGPPCPPCP APEAAGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVCTLPPSQEEMTKNQVSLSCAVKGF YPSDIAVEWESNGQPENNYKTTPPVLDSDGSFFLVSKLTVDKSRWQEGNVFSCSVMHEALHNHYTQKSLSL SLG |
| | 3 | 118 | EVQLVESGGGLVQPGGSLRLSCAASGFNIRDTYIHWVRQAPGKGLEWVARTYPTQGYTRYADSVKGRFTIS ADTSKNTAYLQMNSLRAEDTAVYYCSRWGGSGFYAMDYWGQGTLVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEFLGGPSVFLFPPKPKDTLMISRTPEVTCVVVDVSQEDPEVQFNWYVDGVEVH NAKTKPREEQFNSTYRVVSVLTVLHQDWLNGKEYKCKVSNKGLPSSIEKTISKAKGQPREPQVYTLPPCQEE MTKNQVSLWCLVKGFYPSDIAVEWESNGQPENNYKTTPPVLDSDGSFFLYSKLTVDKSRWQEGNVFSCSV MHEALHNHYTQKSLSLSLG |
| | 4 | 119 | DIQMTQSPSSLSASVGDRVTITCRASQDVNTAVAWYQQKPGKAPKLLIYSASFLYSGVPSRFSGSRSGTDFTL TISSLQPEDFATYYCQQHYTTPPTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC |
| HER2-30R/ 56A/102S + LC-WT-trastuzumab/ CD28supxCD3mid L1 linker IgG4 FALA BP # 11 | 1 | 120 | DIVMTQTPLSLSVTPGQPASISCKSSQSLVHNNANTYLSWYLQKPGQSPQSLIYKVSNRFSGVPDRFSGSGSG TDFTLKISRVEAEDVGVYYCGQGTQYPFTFGSGTKVEIKGQPKAAPDIQMTQSPSSLSASVGDRVTITCQASQ NIYVWLNWYQQKPGKAPKLLIYKASNLHTGVPSRFSGSGSGTDFTLTISSLQPEDIATYYCQQGQTYPYTFG QGTKLEIKTKGPSRTVAAPSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | 2 | 121 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSSQVQLVESGGGVVQPGRSLR LSCAASGFTFTKAWMHWVRQAPGKQLEWVAQIKDKSNSYATYYADSVKGRFTISRDDSKNTLYLQMNSLR AEDTAVYYCRGVYYALSPFDYWGQGTLVTVSSRTASTKGPSVFPLAPCSRSTSESTAALGCLVKDYFPEPVT VSWNSGALTSGVHTFPAVLQSSGLYSLSSVVTVPSSSLGTKTYTCNVDHKPSNTKVDKRVESKYGPPCPPCP APEAAGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVCTLPPSQEEMTKNQVSLSCAVKGF YPSDIAVEWESNGQPENNYKTTPPVLDSDGSFFLVSKLTVDKSRWQEGNVFSCSVMHEALHNHYTQKSLSL SLG |
| | 3 | 122 | EVQLVESGGGLVQPGGSLRLSCAASGFNIRDTYIHWVRQAPGKGLEWVARIYPTNAYTRYADSVKGRFTIS ADTSKNTAYLQMNSLRAEDTAVYYCSRWGGSGFYAMDYWGQGTLVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEFLGGPSVFLFPPKPKDTLMISRTPEVTCVVVDVSQEDPEVQFNWYVDGVEVH NAKTKPREEQFNSTYRVVSVLTVLHQDWLNGKEYKCKVSNKGLPSSIEKTISKAKGQPREPQVYTLPPCQEE MTKNQVSLWCLVKGFYPSDIAVEWESNGQPENNYKTTPPVLDSDGSFFLYSKLTVDKSRWQEGNVFSCSV MHEALHNHYTQKSLSLSLG |

TABLE 1-continued

Trispecific binding protein polypeptide sequences

| Molecule | Poly-peptide Number (acc. to formula) | SEQ ID NO | Sequence |
|---|---|---|---|
| | 4 | 123 | DIQMTQSPSSLSASVGDRVTITCRASQDVNTAVAWYQQKPGKAPKLLIYSASFLYSGVPSRFSGSRSGTDFTL TISSLQPEDFATYYCQQHYTTPPTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC |
| HER2-30R/ 56A/102E/ CD28supxCD3mid L1 linker IgG4 FALA BP # 12 | 1 | 124 | DIVMTQTPLSLSVTPGQPASISCKSSQSLVHNNANTYLSWYLQKPGQSPQSLIYKVSNRFSGVPDRFSGSGSG TDFTLKISRVEAEDVGVYYCGQGTQYPFTFGSGTKVEIKGQPKAAPDIQMTQSPSSLSASVGDRVTITCQASQ NIYVWLNWYQQKPGKAPKWYKASNLHTGVPSRFSGSGSGTDFTLTISSLQPEDIATYYCQQGQTYPYTFG QGTKLEIKTKGPSRTVAAPSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | 2 | 125 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSSQVQLVESGGGVVQPGRSLR LSCAASGFTFTKAWMHWVRQAPGKQLEWVAQIKDKSNSYATYYADSVKGRFTISRDDSKNTLYLQMNSLR AEDTAVYYCRGVYYALSPFDYWGQGTLVTVSSRTASTKGPSVFPLAPCSRSTSESTAALGCLVKDYFPEPVT VSWNSGALTSGVHTFPAVLQSSGLYSLSSVVTVPSSSLGTKTYTCNVDHKPSNTKVDKRVESKYGPPCPPCP APEAAGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVCTLPPSQEEMTKNQVSLSCAVKGF YPSDIAVEWESNGQPENNYKTTPPVLDSDGSFFLVSKLTVDKSRWQEGNVFSCSVMHEALHNHYTQKSLSL SLG |
| | 3 | 126 | EVQLVESGGGLVQPGGSLRLSCAASGFNIRDTYIHWVRQAPGKGLEWVARTYPTNAYTRYADSVKGRFTIS ADTSKNTAYLQMNSLRAEDTAVYYCSRWGGEGFYAMDYWGQGTLVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEFLGGPSVFLFPPKPKDTLMISRTPEVTCVVVDVSQEDPEVQFNWYVDGVEVH NAKTKPREEQFNSTYRVVSVLTVLHQDWLNGKEYKCKVSNKGLPSSIEKTISKAKGQPREPQVYTLPPCQEE MTKNQVSLWCLVKGFYPSDIAVEWESNGQPENNYKTTPPVLDSDGSFFLYSKLTVDKSRWQEGNVFSCSV MHEALHNHYTQKSLSLSLG |
| | 4 | 127 | DIQMTQSPSSLSASVGDRVTITCRASQDVNTAVAWYQQKPGKAPKLLIYSASFLYSGVPSRFSGSRSGTDFTL TISSLQPEDFATYYCQQHYTTPPTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC |
| HER2- WT + trastuzumab/ CD28supxCD3mid (32/3500) L1 linker IgG4 FALA BP # 15 | 1 | 128 | DIVMTQTPLSLSVTPGQPASISCKSSQSLVHQNAQTYLSWYLQKPGQSPQSLIYKVSNRFSGVPDRFSGSGSG TDFTLKISRVEAEDVGVYYCGQGTQYPFTFGSGTKVEIKGQPKAAPDIQMTQSPSSLSASVGDRVTITCQASQ NIYVWLNWYQQKPGKAPKWYKASNLHTGVPSRFSGSGSGTDFTLTISSLQPEDIATYYCQQGQTYPYTFG QGTKLEIKTKGPSRTVAAPSVFIFPPSDEQLKSGTASVVCLLNNFYPREAKVQWKVDNALQSGNSQESVTEQ DSKDSTYSLSSTLTLSKADYEKHKVYACEVTHQGLSSPVTKSFNRGEC |
| | 2 | 129 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSSQVQLVESGGGVVQPGRSLR LSCAASGFTFTKAWMHWVRQAPGKQLEWVAQIKDKSNSYATYYADSVKGRFTISRDDSKNTLYLQMNSLR AEDTAVYYCRGVYYALSPFDYWGQGTLVTVSSRTASTKGPSVFPLAPCSRSTSESTAALGCLVKDYFPEPVT VSWNSGALTSGVHTFPAVLQSSGLYSLSSVVTVPSSSLGTKTYTCNVDHKPSNTKVDKRVESKYGPPCPPCP APEAAGGPSVFLFPPKPKDTLMISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVCTLPPSQEEMTKNQVSLSCAVKGF YPSDIAVEWESNGQPENNYKTTPPVLDSDGSFFLVSKLTVDKSRWQEGNVFSCSVMHEALHNHYTQKSLSL SLG |
| | 3 | 130 | EVQLVESGGGLVQPGGSLRLSCAASGFNIKDTYIHWVRQAPGKGLEWVARIYPTNGYTRYADSVKGRFTIS ADTSKNTAYLQMNSLRAEDTAVYYCSRWGGDGFYAMDYWGQGTLVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEAAGGPSVFLFPPKPKDTLMISRTPEVTCVVVDVSQEDPEVQFNWYVDGVEV HNAKTKPREEQFNSTYRVVSVLTVLHQDWLNGKEYKCKVSNKGLPSSIEKTISKAKGQPREPQVYTLPPCQE EMTKNQVSLWCLVKGFYPSDIAVEWESNGQPENNYKTTPPVLDSDGSFFLYSKLTVDKSRWQEGNVFSCSV MHEALHNHYTQKSLSLSLG |
| | 4 | 131 | DIQMTQSPSSLSASVGDRVTITCRASQDVNTAVAWYQQKPGKAPKLLIYSASFLYSGVPSRFSGSRSGTDFTL TISSLQPEDFATYYCQQHYTTPPTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC |
| HER2/ $CD28_{sup}xCD3_{mid}$ DKTHT linkers on HC/LC) IgG4 FALA BP # 25 | 1 | 132 | DIVMTQTPLSLSVTPGQPASISCKSSQSLVHNNANTYLSWYLQKPGQSPQSLIYKVSNRFSGVPDRFSGSGSG TDFTLKISRVEAEDVGVYYCGQGTQYPFTFGSGTKVEIKDKTHTDIQMTQSPSSLSASVGDRVTITCQASQNI YVWLNWYQQKPGKAPKWYKASNLHTGVPSRFSGSGSGTDFTLTISSLQPEDIATYYCQQGQTYPYTFGQG TKLEIKDKTHTRTVAAPSVFIFPPSDEQLKSGTASVVCLLNNFYPREAKVQWKVDNALQSGNSQESVTEQDS KDSTYSLSSTLTLSKADYEKHKVYACEVTHQGLSSPVTKSFNRGEC |

TABLE 1-continued

Trispecific binding protein polypeptide sequences

| Molecule | Poly-peptide Number (acc. to formula) | SEQ ID NO | Sequence |
| --- | --- | --- | --- |
| | 2 | 133 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 134 | EVQLVESGGGLVQPGGSLRLSCAASGFNIKDTYIHWVRQAPGKGLEWVARIYPTNGYTRYADSVKGRFTIS<br>ADTSKNTAYLQMNSLRAEDTAVYYCSRWGGDGFYAMDYWGQGTLVTVSSASTKGPSVFPLAPCSRSTSES<br>TAALGCLVKDYFPEPVTVSWNSGALTSGVHTFPAVLQSSGLYSLSSVVTVPSSSLGTKTYTCNVDHKPSNTK<br>VDKRVESKYGPPCPPCPAPEAAGGPSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPSSIEKTISKAKGQPREPQVYTLPPCQE<br>EMTKNQVSLWCLVKGFYPSDIAVEWESNGQPENNYKTTPPVLDSDGSFFLYSKLTVDKSRWQEGNVFSCSV<br>MHEALHNHYTQKSLSLSLG |
| | 4 | 135 | DIQMTQSPSSLSASVGDRVTITCRASQDVNTAVAWYQQKPGKAPKLLIYSASFLYSGVPSRFSGSRSGTDFTL<br>TISSLQPEDFATYYCQQHYTTPPTFGQGTKVEIKRTVAAPSVFIFPPSDEQLKSGTASVVCLLNNFYPREAKVQ<br>WKVDNALQSGNSQESVTEQDSKDSTYSLSSTLTLSKADYEKHKVYACEVTHQGLSSPVTKSFNRGEC |
| HER2/ $CD28_{sup}xCD3_{mid}$ (32/33/3435 ENLR (LC); DKTHT linkers on HC/LC) IgG4 FALA BP # 26 | 1 | 136 | DIVMTQTPLSLSVTPGQPASISCKSSQSLVHENLRTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKWYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 137 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 138 | EVQLVESGGGLVQPGGSLRLSCAASGFNIKDTYIHWVRQAPGKGLEWVARIYPTNGYTRYADSVKGRFTIS<br>ADTSKNTAYLQMNSLRAEDTAVYYCSRWGGDGFYAMDYWGQGTLVTVSSASTKGPSVFPLAPCSRSTSES<br>TAALGCLVKDYFPEPVTVSWNSGALTSGVHTFPAVLQSSGLYSLSSVVTVPSSSLGTKTYTCNVDHKPSNTK<br>VDKRVESKYGPPCPPCPAPEAAGGPSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPSSIEKTISKAKGQPREPQVYTLPPCQE<br>EMTKNQVSLWCLVKGFYPSDIAVEWESNGQPENNYKTTPPVLDSDGSFFLYSKLTVDKSRWQEGNVFSCSV<br>MHEALHNHYTQKSLSLSLG |
| | 4 | 139 | DIQMTQSPSSLSASVGDRVTITCRASQDVNTAVAWYQQKPGKAPKLLIYSASFLYSGVPSRFSGSRSGTDFTL<br>TISSLQPEDFATYYCQQHYTTPPTFGQGTKVEIKRTVAAPSVFIFPPSDEQLKSGTASVVCLLNNFYPREAKVQ<br>WKVDNALQSGNSQESVTEQDSKDSTYSLSSTLTLSKADYEKHKVYACEVTHQGLSSPVTKSFNRGEC |
| HER2/ $CD28_{sup}xCD3_{mid}$ (32/33/3435 ENLQ (LC); DKTHT linkers on HC/LC) IgG4 FALA BP # 27 | 1 | 140 | DIVMTQTPLSLSVTPGQPASISCKSSQSLVHENLQTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKLLIYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 141 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |

TABLE 1-continued

| Trispecific binding protein polypeptide sequences | | | |
|---|---|---|---|
| Molecule | Poly-peptide Number (acc. to formula) | SEQ ID NO | Sequence |
| | 3 | 142 | EVQLVESGGGLVQPGGSLRLSCAASGFNIKDTYIHWVRQAPGKGLEWVARIYPTNGYTRYADSVKGRFTIS<br>ADTSKNTAYLQMNSLRAEDTAVYYCSRWGGDGFYAMDYWGQGTLVTVSSASTKGPSVFPLAPCSRSTSES<br>TAALGCLVKDYFPEPVTVSWNSGALTSGVHTFPAVLQSSGLYSLSSVVTVPSSSLGTKTYTCNVDHKPSNTK<br>VDKRVESKYGPPCPPCPAPEAAGGPSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPSSIEKTISKAKGQPREPQVYTLPPCQE<br>EMTKNQVSLWCLVKGFYPSDIAVEWESNGQPENNYKTTPPVLDSDGSFFLYSKLTVDKSRWQEGNVFSCSV<br>MHEALHNHYTQKSLSLSLG |
| | 4 | 143 | DIQMTQSPSSLSASVGDRVTITCRASQDVNTAVAWYQQKPGKAPKLLIYSASFLYSGVPSRFSGSRSGTDFTL<br>TISSLQPEDFATYYCQQHYTTPPTFGQGTKVEIKRTVAAPSVFIFPPSDEQLKSGTASVVCLLNNFYPREAKVQ<br>WKVDNALQSGNSQESVTEQDSKDSTYSLSSTLTLSKADYEKHKVYACEVTHQGLSSPVTKSFNRGEC |
| HER2/<br>CD28$_{sup}$xCD3$_{mid}$<br>(32/33/3435<br>ENLF (LC);<br>DKTHT linkers<br>on HC/LC) IgG4<br>FALA<br>BP # 28 | 1 | 144 | DIVMTQTPLSLSVTPGQPASISCKSSQSLVHENLFTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKLLIYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 145 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 146 | EVQLVESGGGLVQPGGSLRLSCAASGFNIKDTYIHWVRQAPGKGLEWVARIYPTNGYTRYADSVKGRFTIS<br>ADTSKNTAYLQMNSLRAEDTAVYYCSRWGGDGFYAMDYWGQGTLVTVSSASTKGPSVFPLAPCSRSTSES<br>TAALGCLVKDYFPEPVTVSWNSGALTSGVHTFPAVLQSSGLYSLSSVVTVPSSSLGTKTYTCNVDHKPSNTK<br>VDKRVESKYGPPCPPCPAPEAAGGPSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPSSIEKTISKAKGQPREPQVYTLPPCQE<br>EMTKNQVSLWCLVKGFYPSDIAVEWESNGQPENNYKTTPPVLDSDGSFFLYSKLTVDKSRWQEGNVFSCSV<br>MHEALHNHYTQKSLSLSLG |
| | 4 | 147 | DIQMTQSPSSLSASVGDRVTITCRASQDVNTAVAWYQQKPGKAPKLLIYSASFLYSGVPSRFSGSRSGTDFTL<br>TISSLQPEDFATYYCQQHYTTPPTFGQGTKVEIKRTVAAPSVFIFPPSDEQLKSGTASVVCLLNNFYPREAKVQ<br>WKVDNALQSGNSQESVTEQDSKDSTYSLSSTLTLSKADYEKHKVYACEVTHQGLSSPVTKSFNRGEC |
| anti-<br>Her2/CD3/3CD28<br>IgG4 FALA<br>BP #29 | 1 | 148 | DIVMTQTPLSLSVTPGQPASISCKSSQSLVHNNANTYLSWYLQKPGQSPQSLIYKVSNRFSGVPDRFSGSGSG<br>TDFTLKISRVEAEDVGVYYCGQGTQYPFTFGSGTKVEIKGQPKAAPDIQMTQSPSSLSASVGDRVTITCQASQ<br>NIYVWLNWYQQKPGKAPKLLIYKASNLHTGVPSRFSGSGSGTDFTLTISSLQPEDIATYYCQQGQTYPYTFG<br>QGTKLEIKTKGPSRTVAAPSVFIFPPSDEQLKSGTASVVCLLNNFYPREAKVQWKVDNALQSGNSQESVTEQ<br>DSKDSTYSLSSTLTLSKADYEKHKVYACEVTHQGLSSPVTKSFNRGEC |
| | 2 | 149 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSSQVQLVESGGGVVQPGRSLR<br>LSCAASGFTFTKAWMHWVRQAPGKQLEWVAQIKDKSNSYATYYADSVKGRFTISRDDSKNTLYLQMNSLR<br>AEDTAVYYCRGVYYALSPFDYWGQGTLVTVSSRTASTKGPSVFPLAPCSRSTSESTAALGCLVKDYFPEPVT<br>VSWNSGALTSGVHTFPAVLQSSGLYSLSSVVTVPSSSLGTKTYTCNVDHKPSNTKVDKRVESKYGPPCPPCP<br>APEAAGGPSVFLFPPKPKDTLMISRTPEVTCVVVDVSQEDPEVQFNWYVDGVEVHNAKTKPREEQFNSTYR<br>VVSVLTVLHQDWLNGKEYKCKVSNKGLPSSIEKTISKAKGQPREPQVCTLPPSQEEMTKNQVSLSCAVKGF<br>YPSDIAVEWESNGQPENNYKTTPPVLDSDGSFFLVSKLTVDKSRWQEGNVFSCSVMHEALHNHYTQKSLSL<br>SLG |
| | 3 | 150 | EVQLVESGGGLVQPGGSLRLSCAASGFNIKDTYIHWVRQAPGKGLEWVARIYPTNGYTRYADSVKGRFTIS<br>ADTSKNTAYLQMNSLRAEDTAVYYCSRWGGDGFYAMDYWGQGTLVTVSSASTKGPSVFPLAPCSRSTSES<br>TAALGCLVKDYFPEPVTVSWNSGALTSGVHTFPAVLQSSGLYSLSSVVTVPSSSLGTKTYTCNVDHKPSNTK<br>VDKRVESKYGPPCPPCPAPEAAGGPSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPSSIEKTISKAKGQPREPQVYTLPPCQE<br>EMTKNQVSLWCLVKGFYPSDIAVEWESNGQPENNYKTTPPVLDSDGSFFLYSKLTVDKSRWQEGNVFSCSV<br>MHEALHNHYTQKSLSLSLG |
| | 4 | 151 | DIQMTQSPSSLSASVGDRVTITCRASQDVNTAVAWYQQKPGKAPKLLIYSASFLYSGVPSRFSGSRSGTDFTL<br>TISSLQPEDFATYYCQQHYTTPPTFGQGTKVEIKRTVAAPSVFIFPPSDEQLKSGTASVVCLLNNFYPREAKVQ<br>WKVDNALQSGNSQESVTEQDSKDSTYSLSSTLTLSKADYEKHKVYACEVTHQGLSSPVTKSFNRGEC |

TABLE 1-continued

Trispecific binding protein polypeptide sequences

| Molecule | Poly-peptide Number (acc. to formula) | SEQ ID NO | Sequence |
|---|---|---|---|
| HER230R/55Q/102E/CD28$_{sup}$xCD3$_{mid}$ (32/33/3435 ENLR (LC); DKTHT linkers on HC/LC) IgG4 FALA BP # 31 | 1 | 152 | DIVMTQTPLSLSVTPGQPASISCKSSQSLVHENLRTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKWYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 153 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 154 | EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGEGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 155 | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| CD38VH1/CD28sup x CD3mid_ ENLQ DKTHT IgG4 FALA BP # 1 | 1 | 156 | DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 157 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 158 | QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 159 | DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| CD38hhy992/CD28sup x CD3mid_ ENLQ DKTHT IgG4 FALA BP # 5' | 1 | 160 | DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKWYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 161 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQM |

TABLE 1-continued

Trispecific binding protein polypeptide sequences

| Molecule | Poly-peptide Number (acc. to formula) | SEQ ID NO | Sequence |
|---|---|---|---|
| | | | NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 162 | QVQLVQSGAEVKKPGASVKVSCKVSGYTLTEFSIHWVRQAPGQGLEWMGGFDPEDGETIYAQKFQGRVIM<br>TEDTSTDTAYMEMNSLRSEDTAIYYCTTGRFFDWFWGQGTLVTVSSASTKGPSVFPLAPCSRSTSESTAALG<br>CLVKDYFPEPVTVSWNSGALTSGVHTFPAVLQSSGLYSLSSVVTVPSSSLGTKTYTCNVDHKPSNTKVDKRV<br>ESKYGPPCPPCPAPEAAGGPSVFLFPPKPKDTLMISRTPEVTCVVVDVSQEDPEVQFNWYVDGVEVHNAKTK<br>PREEQFNSTYRVVSVLTVLHQDWLNGKEYKCKVSNKGLPSSIEKTISKAKGQPREPQVYTLPPCQEEMTKNQ<br>VSLWCLVKGFYPSDIAVEWESNGQPENNYKTTPPVLDSDGSFFLYSKLTVDKSRWQEGNVFSCSVMHEALH<br>NHYTQKSLSLSLG |
| | 4 | 163 | EIILTQSPAILSLSPGERATLSCRASQSVISRFLSWYQVKPGLAPRLLIYGASTRATGIPVRFSGSGSGTDFSL<br>TISSLQPEDCAVYYCQQDSNLPITFGQGTRLEIKRTVAAPSVFIFPPSDEQLKSGTASVVCLLNNFYPREAKVQ<br>WKVDNALQSGNSQESVTEQDSKDSTYSLSSTLTLSKADYEKHKVYACEVTHQGLSSPVTKSFNRGEC |
| CD38hyb5739/<br>CD28sup x<br>CD3mid_<br>ENLQ DKTHT<br>IgG4 FALA<br>BP # 6' | 1 | 164 | DIVMTQTPLSLSVTPGQPASISCKSSQSLVHENLQTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKWYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 165 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTOVOLVESGGGVVOPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 166 | QVQLQQSGPELVRPGTSVKVSCKASGYAFTTYLVEWIKQRPGQGLEWIGVINPGSGSTNYNEKFKGKATLT<br>VDRSSTTAYMHLSGLTSDDSAVYFCARYAYGYWGQGTTLTVSSASTKGPSVFPLAPCSRSTSESTAALGCLV<br>KDYFPEPVTVSWNSGALTSGVHTFPAVLQSSGLYSLSSVVTVPSSSLGTKTYTCNVDHKPSNTKVDKRVESK<br>YGPPCPPCPAPEAAGGPSVFLFPPKPKDTLMISRTPEVTCVVVDVSQEDPEVQFNWYVDGVEVHNAKTKPRE<br>EQFNSTYRVVSVLTVLHQDWLNGKEYKCKVSNKGLPSSIEKTISKAKGQPREPQVYTLPPCQEEMTKNQVS<br>LWCLVKGFYPSDIAVEWESNGQPENNYKTTPPVLDSDGSFFLYSKLTVDKSRWQEGNVFSCSVMHEALHN<br>HYTQKSLSLSLG |
| | 4 | 167 | DIVMTQSQKFMSASVGDRVSITCKASQNVGTAVAWYQQQPGHSPKQLIYSASNRYTGVPDRFTGSGAGTDF<br>TLTISNIQSEDLADYFCQQYSTYPFTFGSGTKLEIKRTVAAPSVFIFPPSDEQLKSGTASVVCLLNNFYPREAK<br>VQWKVDNALQSGNSQESVTEQDSKDSTYSLSSTLTLSKADYEKHKVYACEVTHQGLSSPVTKSFNRGEC |
| CD38hyb6284/<br>CD28sup x<br>CD3mid_<br>ENLQ DKTHT<br>IgG4 FALA<br>BP # 7 | 1 | 168 | DIVMTQTPLSLSVTPGQPASISCKSSQSLVHENLQTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKWYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 169 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 170 | QVQLLQSGAELVRPGVSVKISCTGSGYSFTNYAVHWVKQSHVKSLEWIGVISPYYGDTTYNQKFTGKATMT<br>VDKSSSTAYMELARLTSEDSAIYFCARRFEGFYYSMDYWGQGTSVTVSSASTKGPSVFPLAPCSRSTSESTA<br>ALGCLVKDYFPEPVTVSWNSGALTSGVHTFPAVLQSSGLYSLSSVVTVPSSSLGTKTYTCNVDHKPSNTKVD<br>KRVESKYGPPCPPCPAPEAAGGPSVFLFPPKPKDTLMISRTPEVTCVVVDVSQEDPEVQFNWYVDGVEVHN<br>AKTKPREEQFNSTYRVVSVLTVLHQDWLNGKEYKCKVSNKGLPSSIEKTISKAKGQPREPQVYTLPPCQEEM<br>TKNQVSLWCLVKGFYPSDIAVEWESNGQPENNYKTTPPVLDSDGSFFLYSKLTVDKSRWQEGNVFSCSVMH<br>EALHNHYTQKSLSLSLG |

TABLE 1-continued

Trispecific binding protein polypeptide sequences

| Molecule | Poly-peptide Number (acc. to formula) | SEQ ID NO | Sequence |
|---|---|---|---|
| | 4 | 171 | DVVMIQTPLSLPVSLGDQASISCRPSQSLVHSNGNTYLNWYLQRPGQSPKLLIYKVSKRFSGVPDRFSGSGSG<br>TDFTLKISRVEAEDLGVYLCSQSTHVPLTFGSGTQLEIKRTVAAPSVFIFPPSDEQLKSGTASVVCLLNNFYPR<br>EAKVQWKVDNALQSGNSQESVTEQDSKDSTYSLSSTLTLSKADYEKHKVYACEVTHQGLSSPVTKSFNRGE<br>C |
| CD38hhy1195/ CD28sup x CD3mid_ ENLQ DKTHT IgG4 FALA BP # 8 | 1 | 172 | DIVMTQTPLSLSVTPGQPASISCKSSQSLVHENLQTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKWYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 173 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 174 | QVQLVESGGGVVQPGRSLRLSCAASGFTFSSYGMYWVRQAPGKGLEWVAVIWYDGSNKYYADSVKGRFTI<br>SRDNSKNTLYLQMNSLRAEDTAVYHCARDPGLRYFDGGMDVWGQGTTVTVSSASTKGPSVFPLAPCSRST<br>SESTAALGCLVKDYFPEPVTVSWNSGALTSGVHTFPAVLQSSGLYSLSSVVTVPSSSLGTKTYTCNVDHKPS<br>NTKVDKRVESKYGPPCPPCPAPEAAGGPSVFLFPPKPKDTLMISRTPEVTCVVVDVSQEDPEVQFNWYVDG<br>VEVHNAKTKPREEQFNSTYRVVSVLTVLHQDWLNGKEYKCKVSNKGLPSSIEKTISKAKGQPREPQVYTLPP<br>CQEEMTKNQVSLWCLVKGFYPSDIAVEWESNGQPENNYKTTPPVLDSDGSFFLYSKLTVDKSRWQEGNVFS<br>CSVMHEALHNHYTQKSLSLSLG |
| | 4 | 175 | DIQLTQSPSFLSASVGDRVTITCRASQGISSYLAWYQQKPGKAPKLLIFAASTLHSGVPSRFSGSGSGTEFTLT<br>ISSLQPEDFATYYCQQLNSFPYTFGQGTKLEIKRTVAAPSVFIFPPSDEQLKSGTASVVCLLNNFYPREAKVQW<br>KVDNALQSGNSQESVTEQDSKDSTYSLSSTLTLSKADYEKHKVYACEVTHQGLSSPVTKSFNRGEC |
| CD38hhy1370/ CD28sup x CD3mid_ ENLQ DKTHT IgG4 FALA BP # 9 | 1 | 176 | DIVMTQTPLSLSVTPGQPASISCKSSQSLVHENLQTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKLLIYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 177 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG<br>RSLRLSCAASGFTFTKAWMHWVRQAPGKQLEWVAQIKDKSNSYATYYADSVKGRFTISRDDSKNTLYLQM<br>NSLRAEDTAVYYCRGVYYALSPFDYWGQGTLVTVSSDKTHTASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKY<br>GPPCPPCPAPEAAGGPSVFLFPPKPKDTLMISRTPEVTCVVVDVSQEDPEVQFNWYVDGVEVHNAKTKPREE<br>QFNSTYRVVSVLTVLHQDWLNGKEYKCKVSNKGLPSSIEKTISKAKGQPREPQVCTLPPSQEEMTKNQVSLS<br>CAVKGFYPSDIAVEWESNGQPENNYKTTPPVLDSDGSFFLVSKLTVDKSRWQEGNVFSCSVMHEALHNHYT<br>QKSLSLSLG |
| | 3 | 178 | QVQLVESGGGVVQPGRSLRLSCAASGFTFSSYGMHWVRQAPGKGLEWVAVIWYDGSNKYYADSVKGRFTI<br>SGDNSKNTLYLQMNSLRAEDTAVYYCARMFRGAFDYWGQGTLVTVSSASTKGPSVFPLAPCSRSTSESTAA<br>LGCLVKDYFPEPVTVSWNSGALTSGVHTFPAVLQSSGLYSLSSVVTVPSSSLGTKTYTCNVDHKPSNTKVDK<br>RVESKYGPPCPPCPAPEAAGGPSVFLFPPKPKDTLMISRTPEVTCVVVDVSQEDPEVQFNWYVDGVEVHNA<br>KTKPREEQFNSTYRVVSVLTVLHQDWLNGKEYKCKVSNKGLPSSIEKTISKAKGQPREPQVYTLPPCQEEMT<br>KNQVSLWCLVKGFYPSDIAVEWESNGQPENNYKTTPPVLDSDGSFFLYSKLTVDKSRWQEGNVFSCSVMHE<br>ALHNHYTQKSLSLSLG |
| | 4 | 179 | AIQMTQSPSSLSASVGDRVTITCRASQGIRNDLGWYQQKPGKAPKLLIYAASSLQSGVPSRFSGSGSGTDFTL<br>TISGLQPEDSATYYCLQDYIYYPTFGQGTKVEIKRTVAAPSVFIFPPSDEQLKSGTASVVCLLNNFYPREAKV<br>QWKVDNALQSGNSQESVTEQDSKDSTYSLSSTLTLSKADYEKHKVYACEVTHQGLSSPVTKSFNRGEC |
| CD38hu5739/ CD28sup x CD3mid_ ENLQ DKTHT IgG4 FALA | 1 | 181 | DIVMTQTPLSLSVTPGQPASISCKSSQSLVHENLQTYLSWYLQKPGQSPQSLIYKVSNRFSGVPDRFSGSGSGT<br>DFTLKISRVEAEDVGVYYCGQGTQYPFTFGSGTKVEIKDKTHTDIQMTQSPSSLSASVGDRVTITCQASQNIY<br>VWLNWYQQKPGKAPKLLIYKASNLHTGVPSRFSGSGSGTDFTLTISSLQPEDIATYYCQQGQTYPYTFGQGT<br>KLEIKDKTHTRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| | 2 | 182 | QVQLVQSGAEVVKPGASVKVSCKASGYTFTSYYIHWVRQAPGQGLEWIGSIYPGNVNTNYAQKFQGRATL<br>TVDTSISTAYMELSRLRSDDTAVYYCTRSHYGLDWNFDVWGKGTTVTVSSDKTHTQVQLVESGGGVVQPG |

TABLE 1-continued

Trispecific binding protein polypeptide sequences

| Molecule | Poly-peptide Number (acc. to formula) | SEQ ID NO | Sequence |
|---|---|---|---|
| | | | RSLRLSCAASGFTFTKAWMHWVRQAPGKQLEWVAQIKDKSNSYATYYADSVKGRFTISRDDSKNTLYLQM NSLRAEDTAVYYCRGVYYALSPFDYWGQGTLVTVSSDKTHTASTKGPSVFPLAPCSRSTSESTAALGCLVK DYFPEPVTVSWNSGALTSGVHTFPAVLQSSGLYSLSSVVTVPSSSLGTKTYTCNVDHKPSNTKVDKRVESKY GPPCPPCPAPEAAGGPSVFLFPPKPKDTLMISRTPEVTCVVVDVSQEDPEVQFNWYVDGVEVHNAKTKPREE QFNSTYRVVSVLTVLHQDWLNGKEYKCKVSNKGLPSSIEKTISKAKGQPREPQVCTLPPSQEEMTKNQVSLS CAVKGFYPSDIAVEWESNGQPENNYKTTPPVLDSDGSFFLVSKLTVDKSRWQEGNVFSCSVMHEALHNHYT QKSLSLSLG |
| | 3 | 183 | QVQLVQSGAEVKKPGASVKVSCKASGYAFTTYLVEWIRQRPGQGLEWMGVINPGSGSTNYAQKFQGRVT MTVDRSSTTAYMELSRLRSDDTAVYYCARYAYGYWGQGTLVTVSSASTKGPSVFPLAPCSRSTSESTAALG CLVKDYFPEPVTVSWNSGALTSGVHTFPAVLQSSGLYSLSSVVTVPSSSLGTKTYTCNVDHKPSNTKVDKRV ESKYGPPCPPCPAPEAAGGPSVFLFPPKPKDTLMISRTPEVTCVVVDVSQEDPEVQFNWYVDGVEVHNAKTK PREEQFNSTYRVVSVLTVLHQDWLNGKEYKCKVSNKGLPSSIEKTISKAKGQPREPQVYTLPPCQEEMTKNQ VSLWCLVKGFYPSDIAVEWESNGQPENNYKTTPPVLDSDGSFFLYSKLTVDKSRWQEGNVFSCSVMHEALH NHYTQKSLSLSLG |
| | 4 | 184 | DIQMTQSPSSLSASVGDRVTITCRASQNVGTAVAWYQQKPGKSPKQLIYSASNRYTGVPSRFSGSGSGTDFT LTISSLQPEDLATYYCQQYSTYPFTFGQGTKLEIKRTVAAPSVFIFPPSDEQLKSGTASVVCLLNNFYPREAKV QWKVDNALQSGNSQESVTEQDSKDSTYSLSSTLTLSKADYEKHKVYACEVTHQGLSSPVTKSFNRGEC |
| CD38hu6284/ CD28sup x CD3mid_ ENLQ DKTHT IgG4 FALA | 1 | 185 | DIVMTQTPLSLSVTPGQPASISCKSSQSLVHENLQTYLSWYLQKPGQSPQSLIYKVSNRFSGVPDRFSGSGSGT DFTLKISRVEAEDVGVYYCGQGTQYPFTFGSGTKVEIKDKTHTHTDIQMTQSPSSLSASVGDRVTITCQASQNIY VWLNWYQQKPGKAPKLLIYKASNLHTGVPSRFSGSGSGTDFTLTISSLQPEDIATYYCQQGQTYPYTFGQGT KLEIKDKTHTRTVAAPSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| | 2 | 186 | QVQLVQSGAEVVKPGASVKVSCKASGYTFTSYYIHWVRQAPGQGLEWIGSIYPGNVNTNYAQKFQGRATL TVDTSISTAYMELSRLRSDDTAVYYCTRSHYGLDWNFDVWGKGTTVTVSSDKTHTQVQLVESGGGVVQPG RSLRLSCAASGFTFTKAWMHWVRQAPGKQLEWVAQIKDKSNSYATYYADSVKGRFTISRDDSKNTLYLQM NSLRAEDTAVYYCRGVYYALSPFDYWGQGTLVTVSSDKTHTASTKGPSVFPLAPCSRSTSESTAALGCLVK DYFPEPVTVSWNSGALTSGVHTFPAVLQSSGLYSLSSVVTVPSSSLGTKTYTCNVDHKPSNTKVDKRVESKY GPPCPPCPAPEAAGGPSVFLFPPKPKDTLMISRTPEVTCVVVDVSQEDPEVQFNWYVDGVEVHNAKTKPREE QFNSTYRVVSVLTVLHQDWLNGKEYKCKVSNKGLPSSIEKTISKAKGQPREPQVCTLPPSQEEMTKNQVSLS CAVKGFYPSDIAVEWESNGQPENNYKTTPPVLDSDGSFFLVSKLTVDKSRWQEGNVFSCSVMHEALHNHYT QKSLSLSLG |
| | 3 | 187 | QVQLVQSGAEVKKPGASVKVSCKASGYSFTNYAVHWVRQAPGQGLEWMGVISPYYGDTTYAQKFQGRVT MTVDKSSSTAYMELSRLRSDDTAVYYCARRFEGFYYSMDYWGQGTLVTVSSASTKGPSVFPLAPCSRSTSE STAALGCLVKDYFPEPVTVSWNSGALTSGVHTFPAVLQSSGLYSLSSVVTVPSSSLGTKTYTCNVDHKPSNT KVDKRVESKYGPPCPPCPAPEAAGGPSVFLFPPKPKDTLMISRTPEVTCVVVDVSQEDPEVQFNWYVDGVE VHNAKTKPREEQFNSTYRVVSVLTVLHQDWLNGKEYKCKVSNKGLPSSIEKTISKAKGQPREPQVYTLPPC QEEMTKNQVSLWCLVKGFYPSDIAVEWESNGQPENNYKTTPPVLDSDGSFFLYSKLTVDKSRWQEGNVFSC SVMHEALHNHYTQKSLSLSLG |
| | 4 | 188 | DVVMTQSPLSLPVTLGQPASISCRPSQSLVHSNGNTYLNWYQQRPGQSPKLLIYKVSKRFSGVPDRFSGSGSG TDFTLKISRVEAEDVGVYYCSQSTHVPLTFGGGTKVEIKRTVAAPSVFIFPPSDEQLKSGTASVVCLLNNFYP REAKVQWKVDNALQSGNSQESVTEQDSKDSTYSLSSTLTLSKADYEKHKVYACEVTHQGLSSPVTKSFNRG EC |

TABLE 6

| Trispecific binding protein polynucleotide sequences | | | |
|---|---|---|---|
| Molecule | Polypeptide Number (acc. to formula) | SEQ ID NO | Sequence |
| HER2 (WT-trastuzumab)/ CD28supxCD3mid (32/35 QQ (LC); DKTHT linkers on HC/LC) IgG4 FALA BP # 1 | 1 | 189 | GACATCGTGATGACCCAGACCCCCCTGAGCCTGAGCGTGACACCTGGACAGCCTGCCAGCATCAGCTGCAAGAGC AGCCAGAGCCTGGTGCACCAGAACGCCCAGACCTACCTGAGCTGGTATCTGCAGAAGCCCGGCCAGAGCCCCCAG TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGACAAAACCCATACCGACATCCAGATGACCCAGAGCCCCA GCAGCCTGTCTGCCAGCGTGGGCGACAGAGTGACCATCACCTGTCAGGCCAGCCAGAACATCTACGTGTGGCTGA ACTGGTATCAGCAGAAGCCCGGCAAGGCCCCCAAGCTGCTGATCTACAAGGCCAGCAACCTGCACACCGGCGTGC CCAGCAGATTTTCTGGCAGCGGCTCCGGCACCGACTTCACCCTGACAATCAGCTCCCTGCAGCCCGAGGACATTGC CACCTACTACTGCCAGCAGGGCCAGACCTACCCCTACACCTTTGGCCAGGGCACCAAGCTGGAAATCAAGGATAA GACCCACACCCGTACGGTGGCCGCTCCCAGCGTGTTCATCTTCCCACCTAGCGACGAGCAGCTGAAGTCCGGCACA GCCTCTGTCGTGTGCCTGCTGAACAACTTCTACCCCCGCGAGGCCAAAGTGCAGTGGAAGGTGGACAACGCCCTGC AGAGCGGCAACAGCCAGGAAAGCGTGACCGAGCAGGACAGCAAGGACTCCACCTACAGCCTGAGCAGCACCCTG ACACTGAGCAAGGCCGACTACGAGAAGCACAAGGTGTACGCCTGCGAAGTGACCCACCAGGGCCTGTCTAGCCCC GTGACCAAGAGCTTCAACCGGGGCGAGTGT |
| | 2 | 190 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 191 | GAAGTGCAGCTGGTGGAATCTGGCGGCGGACTGGTGCAGCCTGGCGGATCTCTGAGACTGAGCTGTGCCGCCAGC GGCTTCAACATCAAGGACACCTACATCCACTGGGTGCGCCAGGCCCCTGGCAAGGGACTGGAATGGGTGGCCAGA ATCTACCCCACCAACGGCTACACCAGATACGCCGACAGCGTGAAGGGCCGGTTCACCATCAGCGCCGACACCAGC AAGAACACCGCCTACCTGCAGATGAACAGCCTGCGGGCCGAGGACACCGCCGTGTACTACTGTAGTAGATGGGGA GGCGACGGCTTCTACGCCATGGACTATTGGGGCCAGGGCACCCTCGTGACCGTGTCTAGTGCGTCGACCAAGGGCC |

TABLE 6-continued

Trispecific binding protein polynucleotide sequences

| Molecule | Polypeptide Number (acc. to formula) | SEQ ID NO | Sequence |
|---|---|---|---|
| | | | CATCGGTGTTCCCTCTGGCCCCTTGCAGCAGAAGCACCAGCGAATCTACAGCCGCCCTGGGCTGCCTCGTGAAGGA<br>CTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTAC<br>ACCTGTAACGTGGACCACAAGCCCAGCAACACCAAGGTGGACAAGCGGGTGGAATCTAAGTACGGCCCTCCCTGC<br>CCTCCTTGCCCAGCCCCTGAAGCTGCCGGCGGACCCTCCGTGTTCCTGTTCCCCCCAAAGCCCAAGGACACCCTGA<br>TGATCAGCCGGACCCCCGAAGTGACCTGCGTGGTGGTGGATGTGTCCCAGGAAGATCCCGAGGTGCAGTTCAATT<br>GGTACGTGGACGGCGTGGAAGTGCACAACGCCAAGACCAAGCCCAGAGAGGAACAGTTCAACAGCACCTACCGG<br>GTGGTGTCCGTGCTGACCGTGCTGCACCAGGACTGGCTGAACGGCAAAGAGTACAAGTGCAAGGTGTCCAACAAG<br>GGCCTGCCCAGCTCCATCGAGAAAACCATCAGCAAGGCCAAGGGCCAGCCCCGCGAGCCTCAAGTGTATACCCTG<br>CCCCCTTGCCAGGAAGAGATGACCAAGAACCAGGTGTCCCTGTGGTGTCTCGTGAAAGGCTTCTACCCCAGCGACA<br>TTGCCGTGGAATGGGAGAGCAACGGCCAGCCCGAGAACAACTACAAGACCACCCCCCCTGTGCTGGACAGCGACG<br>GCTCATTCTTCCTGTACTCCAAGCTGACCGTGGACAAGAGCCGGTGGCAGGAAGGCAACGTGTTCAGCTGCTCCGT<br>GATGCACGAGGCCCTGCACAACCACTACACCCAGAAGTCCCTGTCTCTGTCCCTGGGC |
| | 4 | 192 | GACATCCAGATGACCCAGAGCCCCAGCAGCCTGTCTGCCAGCGTGGGCGACAGAGTGACCATCACCTGTAGAGCC<br>AGCCAGGACGTGAACACCGCCGTGGCCTGGTATCAGCAGAAGCCTGGCAAGGCCCCCAAGCTGCTGATCTACAGC<br>GCCAGCTTCCTGTACAGCGGCGTGCCCAGCAGATTCAGCGGAAGCAGAAGCGGCACCGACTTCACCCTGACCATC<br>AGCTCCCTGCAGCCCGAGGACTTCGCCACCTACTACTGCCAGCAGCACTACACCACCCCCCCCACATTTGGCCAGG<br>GCACCAAGGTGGAAATCAAGCGTACGGTGGCCGCTCCCAGCGTGTTCATCTTCCCACCTAGCGACGAGCAGCTGA<br>AGTCCGGCACAGCCTCTGTCGTGTGCCTGCTGAACAACTTCTACCCCCGCGAGGCCAAAGTGCAGTGGAAGGTGG<br>ACAACGCCCTGCAGAGCGGCAACAGCCAGGAAAGCGTGACCGAGCAGGACAGCAAGGACTCCACCTACAGCCTG<br>AGCAGCACCCTGACACTGAGCAAGGCCGACTACGAGAAGCACAAGGTGTACGCCTGCGAAGTGACCCACCAGGG<br>CCTGTCTAGCCCCGTGACCAAGAGCTTCAACCGGGGCGAGTGT |
| HER2 (30R/55Q/102E + LC-WT-trastuzumab)/ CD28supxCD3mid (32/35 QQ (LC); DKTHT linkers on HC /LC) IgG4 FALA BP #2 | 1 | 193 | GACATCGTGATGACCCAGACCCCCCTGAGCCTGAGCGTGACACCTGGACAGCCTGCCAGCATCAGCTGCAAGAGC<br>AGCCAGAGCCTGGTGCACCAGAACGCCCAGACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |
| | 2 | 194 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG |

TABLE 6-continued

| Trispecific binding protein polynucleotide sequences | | | |
|---|---|---|---|
| Molecule | Polypeptide Number (acc. to formula) | SEQ ID NO | Sequence |
| | | | ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 195 | GAAGTGCAGCTGGTGGAATCTGGCGGCGGACTGGTGCAGCCTGGCGGATCTCTGAGACTGAGCTGTGCCGCCAGC GGCTTCAACATCCGGGACACCTACATCCACTGGGTGCGCCAGGCCCCTGGCAAGGGACTGGAATGGGTGGCCAGA ATCTACCCCACCCAGGGCTACACCAGATACGCCGACAGCGTGAAGGGCCGGTTCACCATCAGCGCCGACACCAGC AAGAACACCGCCTACCTGCAGATGAACAGCCTGCGGGCCGAGGACACCGCCGTGTACTACTGTAGTAGATGGGGA GGCGAAGGCTTCTACGCCATGGACTATTGGGGCCAGGGCACCCTCGTGACCGTGTCTAGTGCGTCGACCAAGGGC CCATCGGTGTTCCCTCTGGCCCCTTGCAGCAGAAGCACCAGCGAATCTACAGCCGCCCTGGGCTGCCTCGTGAAGG ACTACTTTCCCGAGCCCGTGACCGTGTCCTGGAACTCTGGCGCTCTGACAAGCGGCGTGCACACCTTTCCAGCCGT GCTCCAGAGCAGCGGCCTGTACTCTCTGAGCAGCGTCGTGACAGTGCCCAGCAGCAGCCTGGGCACCAAGACCTA CACCTGTAACGTGGACCACAAGCCCAGCAACACCAAGGTGGACAAGCGGGTGGAATCTAAGTACGGCCCTCCCTG CCCTCCTTGCCCAGCCCCTGAAGCTGCCGGCGGACCCTCCGTGTTCCTGTTCCCCCCAAAGCCCAAGGACACCCTG ATGATCAGCCGGACCCCCGAAGTGACCTGCGTGGTGGTGGATGTGTCCCAGGAAGATCCCGAGGTGCAGTTCAAT TGGTACGTGGACGGCGTGGAAGTGCACAACGCCAAGACCAAGCCCAGAGAGGAACAGTTCAACAGCACCTACCG GGTGGTGTCCGTGCTGACCGTGCTGCACCAGGACTGGCTGAACGGCAAAGAGTACAAGTGCAAGGTGTCCAACAA GGGCCTGCCCAGCTCCATCGAGAAAACCATCAGCAAGGCCAAGGGCCAGCCCCGCGAGCCTCAAGTGTATACCCT GCCCCCTTGCCAGGAAGAGATGACCAAGAACCAGGTGTCCCTGTGGTGTCTCGTGAAAGGCTTCTACCCCAGCGAC ATTGCCGTGGAATGGGAGAGCAACGGCCAGCCCGAGAACAACTACAAGACCACCCCCCCTGTGCTGGACAGCGAC GGCTCATTCTTCCTGTACTCCAAGCTGACCGTGGACAAGAGCCGGTGGCAGGAAGGCAACGTGTTCAGCTGCTCCG TGATGCACGAGGCCCTGCACAACCACTACACCCAGAAGTCCCTGTCTCTGTCCCTGGGC |
| | 4 | 196 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA |

TABLE 6-continued

| Trispecific binding protein polynucleotide sequences | | | |
|---|---|---|---|
| Molecule | Polypeptide Number (acc. to formula) | SEQ ID NO | Sequence |
| | | | CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| HER2 (30R/55Q/102E + LC-WT-trastuzumab)/ $CD28_{sup}xCD3_{mid}$ (DNAQ (LC); DKTHT linkers on HC/LC) IgG4 FALA BP #8 | 1 | 197 | GACATCGTGATGACCCAGACCCCCCTGAGCCTGAGCGTGACACCTGGACAGCCTGCCAGCATCAGCTGCAAGAGC<br>AGCCAGAGCCTGGTGCACGACAACGCCCAGACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |
| | 2 | 198 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC |

TABLE 6-continued

Trispecific binding protein polynucleotide sequences

| Molecule | Polypeptide Number (acc. to formula) | SEQ ID NO | Sequence |
|---|---|---|---|
| | | | AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| | 3 | 199 | GAAGTGCAGCTGGTGGAATCTGGCGGCGGACTGGTGCAGCCTGGCGGATCTCTGAGACTGAGCTGTGCCGCCAGC<br>GGCTTCAACATCCGGGACACCTACATCCACTGGGTGCGCCAGGCCCCTGGCAAGGGACTGGAATGGGTGGCCAGA<br>ATCTACCCCACCCAGGGCTACACCAGATACGCCGACAGCGTGAAGGGCCGGTTCACCATCAGCGCCGACACCAGC<br>AAGAACACCGCCTACCTGCAGATGAACAGCCTGCGGGCCGAGGACACCGCCGTGTACTACTGTAGTAGATGGGGA<br>GGCGAAGGCTTCTACGCCATGGACTATTGGGGCCAGGGCACCCTCGTGACCGTGTCTAGTGCGTCGACCAAGGGC<br>CCATCGGTGTTCCCTCTGGCCCCTTGCAGCAGAAGCACCAGCGAATCTACAGCCGCCCTGGGCTGCCTCGTGAAGG<br>ACTACTTTCCCGAGCCCGTGACCGTGTCCTGGAACTCTGGCGCTCTGACAAGCGGCGTGCACACCTTTCCAGCCGT<br>GCTCCAGAGCAGCGGCCTGTACTCTCTGAGCAGCGTCGTGACAGTGCCCAGCAGCAGCCTGGGCACCAAGACCTA<br>CACCTGTAACGTGGACCACAAGCCCAGCAACACCAAGGTGGACAAGCGGGTGGAATCTAAGTACGGCCCTCCCTG<br>CCCTCCTTGCCCAGCCCCTGAAGCTGCCGGCGGACCCTCCGTGTTCCTGTTCCCCCCAAAGCCCAAGGACACCCTG<br>ATGATCAGCCGGACCCCCGAAGTGACCTGCGTGGTGGTGGATGTGTCCCAGGAAGATCCCGAGGTGCAGTTCAAT<br>TGGTACGTGGACGGCGTGGAAGTGCACAACGCCAAGACCAAGCCCAGAGAGGAACAGTTCAACAGCACCTACCG<br>GGTGGTGTCCGTGCTGACCGTGCTGCACCAGGACTGGCTGAACGGCAAAGAGTACAAGTGCAAGGTGTCCAACAA<br>GGGCCTGCCCAGCTCCATCGAGAAAACCATCAGCAAGGCCAAGGGCCAGCCCCGCGAGCCTCAAGTGTATACCCT<br>GCCCCCTTGCCAGGAAGAGATGACCAAGAACCAGGTGTCCCTGTGGTGTCTCGTGAAAGGCTTCTACCCCAGCGAC<br>ATTGCCGTGGAATGGGAGAGCAACGGCCAGCCCGAGAACAACTACAAGACCACCCCCCCTGTGCTGGACAGCGAC<br>GGCTCATTCTTCCTGTACTCCAAGCTGACCGTGGACAAGAGCCGGTGGCAGGAAGGCAACGTGTTCAGCTGCTCCG<br>TGATGCACGAGGCCCTGCACAACCACTACACCCAGAAGTCCCTGTCTCTGTCCCTGGGC |
| | 4 | 200 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC |

TABLE 6-continued

Trispecific binding protein polynucleotide sequences

| Molecule | Polypeptide Number (acc. to formula) | SEQ ID NO | Sequence |
|---|---|---|---|
| | | | TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| HER2 (30R/55Q/102E + LC-WT-trastuzumab)/ $CD28_{sup}xCD3_{mid}$ (32/35QQ (LC); FALA) Ig G4 L1 linker BP #9 | 1 | 201 | GACATCGTGATGACCCAGACCCCCCTGAGCCTGAGCGTGACACCTGGACAGCCTGCCAGCATCAGCTGCAAGAGC<br>AGCCAGAGCCTGGTGCACCAGAACGCCCAGACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGGCCAGCCCAAGGCCGCCCCCGACATCCAGATGACCCAGA<br>GCCCCAGCAGCCTGTCTGCCAGCGTGGGCGACAGAGTGACCATCACCTGTCAGGCCAGCCAGAACATCTACGTGT<br>GGCTGAACTGGTATCAGCAGAAGCCCGGCAAGGCCCCCAAGCTGCTGATCTACAAGGCCAGCAACCTGCACACCG<br>GCGTGCCCAGCAGATTTTCTGGCAGCGGCTCCGGCACCGACTTCACCCTGACAATCAGCTCCCTGCAGCCCGAGGA<br>CATTGCCACCTACTACTGCCAGCAGGGCCAGACCTACCCCTACACCTTTGGCCAGGGCACCAAGCTGGAAATCAAG<br>ACCAAGGGCCCCAGCCGTACGGTGGCCGCTCCCAGCGTGTTCATCTTCCCACCTAGCGACGAGCAGCTGAAGTCCG<br>GCACAGCCTCTGTCGTGTGCCTGCTGAACAACTTCTACCCCCGCGAGGCCAAAGTGCAGTGGAAGGTGGACAACG<br>CCCTGCAGAGCGGCAACAGCCAGGAAAGCGTGACCGAGCAGGACAGCAAGGACTCCACCTACAGCCTGAGCAGC<br>ACCCTGACACTGAGCAAGGCCGACTACGAGAAGCACAAGGTGTACGCCTGCGAAGTGACCCACCAGGGCCTGTCT<br>AGCCCCGTGACCAAGAGCTTCAACCGGGGCGAGTGT |
| | 2 | 202 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCAGCCAGGTGCAGCTG<br>GTGGAATCTGGCGGCGGAGTGGTGCAGCCTGGCAGAAGCCTGAGACTGAGCTGTGCCGCCAGCGGCTTCACCTTC<br>ACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAA<br>CACCCTGTACCTGCAGATGAACAGCCTGCGGGCCGAGGACACCGCCGTGTACTACTGTCGGGGCGTGTACTATGCC<br>CTGAGCCCCTTCGATTACTGGGGCCAGGGAACCCTCGTGACCGTGTCTAGTCGGACCGCCAGCACAAAGGGCCCAT<br>CGGTGTTCCCTCTGGCCCCTTGCAGCAGAAGCACCAGCGAATCTACAGCCGCCCTGGGCTGCCTCGTGAAGGACTA<br>CTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACC<br>TGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGA<br>TCAGCCGGACCCCCGAAGTGACCTGCGTGGTGGTGGATGTGTCCCAGGAAGATCCCGAGGTGCAGTTCAATTGGT<br>ACGTGGACGGCGTGGAAGTGCACAACGCCAAGACCAAGCCCAGAGAGGAACAGTTCAACAGCACCTACCGGGTG<br>GTGTCCGTGCTGACCGTGCTGCACCAGGACTGGCTGAACGGCAAAGAGTACAAGTGCAAGGTGTCCAACAAGGGC<br>CTGCCCAGCTCCATCGAGAAAACCATCAGCAAGGCCAAGGGCCAGCCCCGCGAGCCTCAAGTGTGTACCCTGCCC<br>CCTAGCCAGGAAGAGATGACCAAGAACCAGGTGTCCCTGAGCTGTGCCGTGAAAGGCTTCTACCCCAGCGACATT<br>GCCGTGGAATGGGAGAGCAACGGCCAGCCCGAGAACAACTACAAGACCACCCCCCCTGTGCTGGACAGCGACGG<br>CTCATTCTTCCTGGTGTCCAAGCTGACCGTGGACAAGAGCCGGTGGCAGGAAGGCAACGTGTTCAGCTGCTCCGTG<br>ATGCACGAGGCCCTGCACAACCACTACACCCAGAAGTCCCTGTCTCTGTCCCTGGGC |
| | 3 | 203 | GAAGTGCAGCTGGTGGAATCTGGCGGCGGACTGGTGCAGCCTGGCGGATCTCTGAGACTGAGCTGTGCCGCCAGC<br>GGCTTCAACATCCGGGACACCTACATCCACTGGGTGCGCCAGGCCCCTGGCAAGGGACTGGAATGGGTGGCCAGA<br>ATCTACCCCACCCAGGGCTACACCAGATACGCCGACAGCGTGAAGGGCCGGTTCACCATCAGCGCCGACACCAGC |

TABLE 6-continued

| Trispecific binding protein polynucleotide sequences | | | |
|---|---|---|---|
| Molecule | Polypeptide Number (acc. to formula) | SEQ ID NO | Sequence |
| | | | AAGAACACCGCCTACCTGCAGATGAACAGCCTGCGGGCCGAGGACACCGCCGTGTACTACTGTAGTAGATGGGGA<br>GGCGAAGGCTTCTACGCCATGGACTATTGGGGCCAGGGCACCCTCGTGACCGTGTCTAGTGCGTCGACCAAGGGC<br>CCATCGGTGTTCCCTCTGGCCCCTTGCAGCAGAAGCACCAGCGAATCTACAGCCGCCCTGGGCTGCCTCGTGAAGG<br>ACTACTTTCCCGAGCCCGTGACCGTGTCCTGGAACTCTGGCGCTCTGACAAGCGGCGTGCACACCTTTCCAGCCGT<br>GCTCCAGAGCAGCGGCCTGTACTCTCTGAGCAGCGTCGTGACAGTGCCCAGCAGCAGCCTGGGCACCAAGACCTA<br>CACCTGTAACGTGGACCACAAGCCCAGCAACACCAAGGTGGACAAGCGGGTGGAATCTAAGTACGGCCCTCCCTG<br>CCCTCCTTGCCCAGCCCCTGAAGCTGCCGGCGGACCCTCCGTGTTCCTGTTCCCCCCAAAGCCCAAGGACACCCTG<br>ATGATCAGCCGGACCCCCGAAGTGACCTGCGTGGTGGTGGATGTGTCCCAGGAAGATCCCGAGGTGCAGTTCAAT<br>TGGTACGTGGACGGCGTGGAAGTGCACAACGCCAAGACCAAGCCCAGAGAGGAACAGTTCAACAGCACCTACCG<br>GGTGGTGTCCGTGCTGACCGTGCTGCACCAGGACTGGCTGAACGGCAAAGAGTACAAGTGCAAGGTGTCCAACAA<br>GGGCCTGCCCAGCTCCATCGAGAAAACCATCAGCAAGGCCAAGGGCCAGCCCCGCGAGCCTCAAGTGTATACCCT<br>GCCCCCTTGCCAGGAAGAGATGACCAAGAACCAGGTGTCCCTGTGGTGTCTCGTGAAAGGCTTCTACCCCAGCGAC<br>ATTGCCGTGGAATGGGAGAGCAACGGCCAGCCCGAGAACAACTACAAGACCACCCCCCCTGTGCTGGACAGCGAC<br>GGCTCATTCTTCCTGTACTCCAAGCTGACCGTGGACAAGAGCCGGTGGCAGGAAGGCAACGTGTTCAGCTGCTCCG<br>TGATGCACGAGGCCCTGCACAACCACTACACCCAGAAGTCCCTGTCTCTGTCCCTGGGC |
| | 4 | 204 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| HER2-30R/ 55Q/102S + LC-WT-trastuzumab/ CD28supxCD3mid L1 linker | 1 | 205 | GACATCGTGATGACCCAGACCCCCCTGAGCCTGAGCGTGACACCTGGACAGCCTGCCAGCATCAGCTGCAAGAGC<br>AGCCAGAGCCTGGTGCACAACAACGCCAACACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGGCCAGCCCAAGGCCGCCCCCGACATCCAGATGACCCAGA<br>GCCCCAGCAGCCTGTCTGCCAGCGTGGGCGACAGAGTGACCATCACCTGTCAGGCCAGCCAGAACATCTACGTGT |

TABLE 6-continued

| Trispecific binding protein polynucleotide sequences | | | |
|---|---|---|---|
| Molecule | Polypeptide Number (acc. to formula) | SEQ ID NO | Sequence |
| IgG4 FALA BP #10 | | | GGCTGAACTGGTATCAGCAGAAGCCCGGCAAGGCCCCCAAGCTGCTGATCTACAAGGCCAGCAACCTGCACACCG GCGTGCCCAGCAGATTTTCTGGCAGCGGCTCCGGCACCGACTTCACCCTGACAATCAGCTCCCTGCAGCCCGAGGA CATTGCCACCTACTACTGCCAGCAGGGCCAGACCTACCCCTACACCTTTGGCCAGGGCACCAAGCTGGAAATCAAG ACCAAGGGCCCCAGCCGTACGGTGGCCGCTCCCAGCGTGTTCATCTTCCCACCTAGCGACGAGCAGCTGAAGTCCG GCACAGCCTCTGTCGTGTGCCTGCTGAACAACTTCTACCCCCGCGAGGCCAAAGTGCAGTGGAAGGTGGACAACG CCCTGCAGAGCGGCAACAGCCAGGAAAGCGTGACCGAGCAGGACAGCAAGGACTCCACCTACAGCCTGAGCAGC ACCCTGACACTGAGCAAGGCCGACTACGAGAAGCACAAGGTGTACGCCTGCGAAGTGACCCACCAGGGCCTGTCT AGCCCCGTGACCAAGAGCTTCAACCGGGGCGAGTGT |
| | 2 | 206 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCAGCCAGGTGCAGCTG GTGGAATCTGGCGGCGGAGTGGTGCAGCCTGGCAGAAGCCTGAGACTGAGCTGTGCCGCCAGCGGCTTCACCTTC ACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAA CACCCTGTACCTGCAGATGAACAGCCTGCGGGCCGAGGACACCGCCGTGTACTACTGTCGGGGCGTGTACTATGCC CTGAGCCCCTTCGATTACTGGGGCCAGGGAACCCTCGTGACCGTGTCTAGTCGGACCGCCAGCACAAAGGGCCCAT CGGTGTTCCCTCTGGCCCCTTGCAGCAGAAGCACCAGCGAATCTACAGCCGCCCTGGGCTGCCTCGTGAAGGACTA CTTTCCCGAGCCCGTGACCGTGTCCTGGAACTCTGGCGCTCTGACAAGCGGCGTGCACACCTTTCCAGCCGTGCTC CAGAGCAGCGGCCTGTACTCTCTGAGCAGCGTCGTGACAGTGCCCAGCAGCAGCCTGGGCACCAAGACCTACACC TGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGA TCAGCCGGACCCCCGAAGTGACCTGCGTGGTGGTGGATGTGTCCCAGGAAGATCCCGAGGTGCAGTTCAATTGGT ACGTGGACGGCGTGGAAGTGCACAACGCCAAGACCAAGCCCAGAGAGGAACAGTTCAACAGCACCTACCGGGTG GTGTCCGTGCTGACCGTGCTGCACCAGGACTGGCTGAACGGCAAAGAGTACAAGTGCAAGGTGTCCAACAAGGGC CTGCCCAGCTCCATCGAGAAAACCATCAGCAAGGCCAAGGGCCAGCCCCGCGAGCCTCAAGTGTGTACCCTGCCC CCTAGCCAGGAAGAGATGACCAAGAACCAGGTGTCCCTGAGCTGTGCCGTGAAAGGCTTCTACCCCAGCGACATT GCCGTGGAATGGGAGAGCAACGGCCAGCCCGAGAACAACTACAAGACCACCCCCCCTGTGCTGGACAGCGACGG CTCATTCTTCCTGGTGTCCAAGCTGACCGTGGACAAGAGCCGGTGGCAGGAAGGCAACGTGTTCAGCTGCTCCGTG ATGCACGAGGCCCTGCACAACCACTACACCCAGAAGTCCCTGTCTCTGTCCCTGGGC |
| | 3 | 207 | GAAGTGCAGCTGGTGGAATCTGGCGGCGGACTGGTGCAGCCTGGCGGATCTCTGAGACTGAGCTGTGCCGCCAGC GGCTTCAACATCCGGGACACCTACATCCACTGGGTGCGCCAGGCCCCTGGCAAGGGACTGGAATGGGTGGCCAGA ATCTACCCCACCCAGGGCTACACCAGATACGCCGACAGCGTGAAGGGCCGGTTCACCATCAGCGCCGACACCAGC AAGAACACCGCCTACCTGCAGATGAACAGCCTGCGGGCCGAGGACACCGCCGTGTACTACTGTAGTAGATGGGGA GGCTCCGGCTTCTACGCCATGGACTATTGGGGCCAGGGCACCCTCGTGACCGTGTCTAGTGCGTCGACCAAGGGCC CATCGGTGTTCCCTCTGGCCCCTTGCAGCAGAAGCACCAGCGAATCTACAGCCGCCCTGGGCTGCCTCGTGAAGGA CTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTAC ACCTGTAACGTGGACCACAAGCCCAGCAACACCAAGGTGGACAAGCGGGTGGAATCTAAGTACGGCCCTCCCTGC CCTCCTTGCCCAGCCCCTGAATTTCTGGGCGGACCCTCCGTGTTCCTGTTCCCCCCAAAGCCCAAGGACACCCTGAT GATCAGCCGGACCCCCGAAGTGACCTGCGTGGTGGTGGATGTGTCCCAGGAAGATCCCGAGGTGCAGTTCAATTG GTACGTGGACGGCGTGGAAGTGCACAACGCCAAGACCAAGCCCAGAGAGGAACAGTTCAACAGCACCTACCGGG TGGTGTCCGTGCTGACCGTGCTGCACCAGGACTGGCTGAACGGCAAAGAGTACAAGTGCAAGGTGTCCAACAAGG |

TABLE 6-continued

Trispecific binding protein polynucleotide sequences

| Molecule | Polypeptide Number (acc. to formula) | SEQ ID NO | Sequence |
|---|---|---|---|
| | | | GCCTGCCCAGCTCCATCGAGAAAACCATCAGCAAGGCCAAGGGCCAGCCCCGCGAGCCTCAAGTGTATACCCTGC<br>CCCCTTGCCAGGAAGAGATGACCAAGAACCAGGTGTCCCTGTGGTGTCTCGTGAAAGGCTTCTACCCCAGCGACAT<br>TGCCGTGGAATGGGAGAGCAACGGCCAGCCCGAGAACAACTACAAGACCACCCCCCCTGTGCTGGACAGCGACGG<br>CTCATTCTTCCTGTACTCCAAGCTGACCGTGGACAAGAGCCGGTGGCAGGAAGGCAACGTGTTCAGCTGCTCCGTG<br>ATGCACGAGGCCCTGCACAACCACTACACCCAGAAGTCCCTGTCTCTGTCCCTGGGC |
| | 4 | 208 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| HER2-30R/<br>56A/102S + LC-<br>WT-<br>trastuzumab/<br>CD28supxCD3mid<br>L1 linker IgG4<br>FALA<br>BP #11 | 1 | 209 | GACATCGTGATGACCCAGACCCCCCTGAGCCTGAGCGTGACACCTGGACAGCCTGCCAGCATCAGCTGCAAGAGC<br>AGCCAGAGCCTGGTGCACAACAACGCCAACACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGGCCAGCCCAAGGCCGCCCCCGACATCCAGATGACCCAGA<br>GCCCCAGCAGCCTGTCTGCCAGCGTGGGCGACAGAGTGACCATCACCTGTCAGGCCAGCCAGAACATCTACGTGT<br>GGCTGAACTGGTATCAGCAGAAGCCCGGCAAGGCCCCCAAGCTGCTGATCTACAAGGCCAGCAACCTGCACACCG<br>GCGTGCCCAGCAGATTTTCTGGCAGCGGCTCCGGCACCGACTTCACCCTGACAATCAGCTCCCTGCAGCCCGAGGA<br>CATTGCCACCTACTACTGCCAGCAGGGCCAGACCTACCCCTACACCTTTGGCCAGGGCACCAAGCTGGAAATCAAG<br>ACCAAGGGCCCCAGCCGTACGGTGGCCGCTCCCAGCGTGTTCATCTTCCCACCTAGCGACGAGCAGCTGAAGTCCG<br>GCACAGCCTCTGTCGTGTGCCTGCTGAACAACTTCTACCCCCGCGAGGCCAAAGTGCAGTGGAAGGTGGACAACG<br>CCCTGCAGAGCGGCAACAGCCAGGAAAGCGTGACCGAGCAGGACAGCAAGGACTCCACCTACAGCCTGAGCAGC<br>ACCCTGACACTGAGCAAGGCCGACTACGAGAAGCACAAGGTGTACGCCTGCGAAGTGACCCACCAGGGCCTGTCT<br>AGCCCCGTGACCAAGAGCTTCAACCGGGGCGAGTGT |
| | 2 | 210 | CAGGTGCAGCTGGTGCAGTCTGGCGCCGAGGTCGTGAAACCTGGCGCCTCTGTGAAGGTGTCCTGCAAGGCCAGC |

TABLE 6-continued

| Trispecific binding protein polynucleotide sequences | | | |
|---|---|---|---|
| Molecule | Polypeptide Number (acc. to formula) | SEQ ID NO | Sequence |
| | | | GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCAGCCAGGTGCAGCTG<br>GTGGAATCTGGCGGCGGAGTGGTGCAGCCTGGCAGAAGCCTGAGACTGAGCTGTGCCGCCAGCGGCTTCACCTTC<br>ACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAA<br>CACCCTGTACCTGCAGATGAACAGCCTGCGGGCCGAGGACACCGCCGTGTACTACTGTCGGGGCGTGTACTATGCC<br>CTGAGCCCCTTCGATTACTGGGGCCAGGGAACCCTCGTGACCGTGTCTAGTCGGACCGCCAGCACAAAGGGCCCAT<br>CGGTGTTCCCTCTGGCCCCTTGCAGCAGAAGCACCAGCGAATCTACAGCCGCCCTGGGCTGCCTCGTGAAGGACTA<br>CTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACC<br>TGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGA<br>TCAGCCGGACCCCCGAAGTGACCTGCGTGGTGGTGGATGTGTCCCAGGAAGATCCCGAGGTGCAGTTCAATTGGT<br>ACGTGGACGGCGTGGAAGTGCACAACGCCAAGACCAAGCCCAGAGAGGAACAGTTCAACAGCACCTACCGGGTG<br>GTGTCCGTGCTGACCGTGCTGCACCAGGACTGGCTGAACGGCAAAGAGTACAAGTGCAAGGTGTCCAACAAGGGC<br>CTGCCCAGCTCCATCGAGAAAACCATCAGCAAGGCCAAGGGCCAGCCCCGCGAGCCTCAAGTGTGTACCCTGCCC<br>CCTAGCCAGGAAGAGATGACCAAGAACCAGGTGTCCCTGAGCTGTGCCGTGAAAGGCTTCTACCCCAGCGACATT<br>GCCGTGGAATGGGAGAGCAACGGCCAGCCCGAGAACAACTACAAGACCACCCCCCCTGTGCTGGACAGCGACGG<br>CTCATTCTTCCTGGTGTCCAAGCTGACCGTGGACAAGAGCCGGTGGCAGGAAGGCAACGTGTTCAGCTGCTCCGTG<br>ATGCACGAGGCCCTGCACAACCACTACACCCAGAAGTCCCTGTCTCTGTCCCTGGGC |
| | 3 | 211 | GAAGTGCAGCTGGTGGAATCTGGCGGCGGACTGGTGCAGCCTGGCGGATCTCTGAGACTGAGCTGTGCCGCCAGC<br>GGCTTCAACATCCGGGACACCTACATCCACTGGGTGCGCCAGGCCCCTGGCAAGGGACTGGAATGGGTGGCCAGA<br>ATCTACCCCACCAACGCCTACACCAGATACGCCGACAGCGTGAAGGGCCGGTTCACCATCAGCGCCGACACCAGC<br>AAGAACACCGCCTACCTGCAGATGAACAGCCTGCGGGCCGAGGACACCGCCGTGTACTACTGTAGTAGATGGGGA<br>GGCTCCGGCTTCTACGCCATGGACTATTGGGGCCAGGGCACCCTCGTGACCGTGTCTAGTGCGTCGACCAAGGGCC<br>CATCGGTGTTCCCTCTGGCCCCTTGCAGCAGAAGCACCAGCGAATCTACAGCCGCCCTGGGCTGCCTCGTGAAGGA<br>CTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTAC<br>ACCTGTAACGTGGACCACAAGCCCAGCAACACCAAGGTGGACAAGCGGGTGGAATCTAAGTACGGCCCTCCCTGC<br>CCTCCTTGCCCAGCCCCTGAATTTCTGGGCGGACCCTCCGTGTTCCTGTTCCCCCCAAAGCCCAAGGACACCCTGAT<br>GATCAGCCGGACCCCCGAAGTGACCTGCGTGGTGGTGGATGTGTCCCAGGAAGATCCCGAGGTGCAGTTCAATTG<br>GTACGTGGACGGCGTGGAAGTGCACAACGCCAAGACCAAGCCCAGAGAGGAACAGTTCAACAGCACCTACCGGG<br>TGGTGTCCGTGCTGACCGTGCTGCACCAGGACTGGCTGAACGGCAAAGAGTACAAGTGCAAGGTGTCCAACAAGG<br>GCCTGCCCAGCTCCATCGAGAAAACCATCAGCAAGGCCAAGGGCCAGCCCCGCGAGCCTCAAGTGTATACCCTGC<br>CCCCTTGCCAGGAAGAGATGACCAAGAACCAGGTGTCCCTGTGGTGTCTCGTGAAAGGCTTCTACCCCAGCGACAT<br>TGCCGTGGAATGGGAGAGCAACGGCCAGCCCGAGAACAACTACAAGACCACCCCCCCTGTGCTGGACAGCGACGG<br>CTCATTCTTCCTGTACTCCAAGCTGACCGTGGACAAGAGCCGGTGGCAGGAAGGCAACGTGTTCAGCTGCTCCGTG<br>ATGCACGAGGCCCTGCACAACCACTACACCCAGAAGTCCCTGTCTCTGTCCCTGGGC |
| | 4 | 212 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC |

TABLE 6-continued

| Molecule | Polypeptide Number (acc. to formula) | SEQ ID NO | Sequence |
|---|---|---|---|
| Trispecific binding protein polynucleotide sequences | | | |
| | | | TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| HER2-30R/<br>56A/102E/<br>CD28supxCD3mid<br>L1 linker IgG4<br>FALA<br>BP #12 | 1 | 213 | GACATCGTGATGACCCAGACCCCCCTGAGCCTGAGCGTGACACCTGGACAGCCTGCCAGCATCAGCTGCAAGAGC<br>AGCCAGAGCCTGGTGCACAACAACGCCAACACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGGCCAGCCCAAGGCCGCCCCCGACATCCAGATGACCCAGA<br>GCCCCAGCAGCCTGTCTGCCAGCGTGGGCGACAGAGTGACCATCACCTGTCAGGCCAGCCAGAACATCTACGTGT<br>GGCTGAACTGGTATCAGCAGAAGCCCGGCAAGGCCCCCAAGCTGCTGATCTACAAGGCCAGCAACCTGCACACCG<br>GCGTGCCCAGCAGATTTTCTGGCAGCGGCTCCGGCACCGACTTCACCCTGACAATCAGCTCCCTGCAGCCCGAGGA<br>CATTGCCACCTACTACTGCCAGCAGGGCCAGACCTACCCCTACACCTTTGGCCAGGGCACCAAGCTGGAAATCAAG<br>ACCAAGGGCCCCAGCCGTACGGTGGCCGCTCCCAGCGTGTTCATCTTCCCACCTAGCGACGAGCAGCTGAAGTCCG<br>GCACAGCCTCTGTCGTGTGCCTGCTGAACAACTTCTACCCCCGCGAGGCCAAAGTGCAGTGGAAGGTGGACAACG<br>CCCTGCAGAGCGGCAACAGCCAGGAAAGCGTGACCGAGCAGGACAGCAAGGACTCCACCTACAGCCTGAGCAGC<br>ACCCTGACACTGAGCAAGGCCGACTACGAGAAGCACAAGGTGTACGCCTGCGAAGTGACCCACCAGGGCCTGTCT<br>AGCCCCGTGACCAAGAGCTTCAACCGGGGCGAGTGT |
| | 2 | 214 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCAGCCAGGTGCAGCTG<br>GTGGAATCTGGCGGCGGAGTGGTGCAGCCTGGCAGAAGCCTGAGACTGAGCTGTGCCGCCAGCGGCTTCACCTTC<br>ACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAA<br>CACCCTGTACCTGCAGATGAACAGCCTGCGGGCCGAGGACACCGCCGTGTACTACTGTCGGGGCGTGTACTATGCC<br>CTGAGCCCCTTCGATTACTGGGGCCAGGGAACCCTCGTGACCGTGTCTAGTCGGACCGCCAGCACAAAGGGCCCAT<br>CGGTGTTCCCTCTGGCCCCTTGCAGCAGAAGCACCAGCGAATCTACAGCCGCCCTGGGCTGCCTCGTGAAGGACTA |

TABLE 6-continued

Trispecific binding protein polynucleotide sequences

| Molecule | Polypeptide Number (acc. to formula) | SEQ ID NO | Sequence |
|---|---|---|---|
| | | | CTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACC<br>TGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGA<br>TCAGCCGGACCCCCGAAGTGACCTGCGTGGTGGTGGATGTGTCCCAGGAAGATCCCGAGGTGCAGTTCAATTGGT<br>ACGTGGACGGCGTGGAAGTGCACAACGCCAAGACCAAGCCCAGAGAGGAACAGTTCAACAGCACCTACCGGGTG<br>GTGTCCGTGCTGACCGTGCTGCACCAGGACTGGCTGAACGGCAAAGAGTACAAGTGCAAGGTGTCCAACAAGGGC<br>CTGCCCAGCTCCATCGAGAAAACCATCAGCAAGGCCAAGGGCCAGCCCCGCGAGCCTCAAGTGTGTACCCTGCCC<br>CCTAGCCAGGAAGAGATGACCAAGAACCAGGTGTCCCTGAGCTGTGCCGTGAAAGGCTTCTACCCCAGCGACATT<br>GCCGTGGAATGGGAGAGCAACGGCCAGCCCGAGAACAACTACAAGACCACCCCCCCTGTGCTGGACAGCGACGG<br>CTCATTCTTCCTGGTGTCCAAGCTGACCGTGGACAAGAGCCGGTGGCAGGAAGGCAACGTGTTCAGCTGCTCCGTG<br>ATGCACGAGGCCCTGCACAACCACTACACCCAGAAGTCCCTGTCTCTGTCCCTGGGC |
| | 3 | 215 | GAAGTGCAGCTGGTGGAATCTGGCGGCGGACTGGTGCAGCCTGGCGGATCTCTGAGACTGAGCTGTGCCGCCAGC<br>GGCTTCAACATCCGGGACACCTACATCCACTGGGTGCGCCAGGCCCCTGGCAAGGGACTGGAATGGGTGGCCAGA<br>ATCTACCCCACCAACGCCTACACCAGATACGCCGACAGCGTGAAGGGCCGGTTCACCATCAGCGCCGACACCAGC<br>AAGAACACCGCCTACCTGCAGATGAACAGCCTGCGGGCCGAGGACACCGCCGTGTACTACTGTAGTAGATGGGGA<br>GGCGAAGGCTTCTACGCCATGGACTATTGGGGCCAGGGCACCCTCGTGACCGTGTCTAGTGCGTCGACCAAGGGC<br>CCATCGGTGTTCCCTCTGGCCCCTTGCAGCAGAAGCACCAGCGAATCTACAGCCGCCCTGGGCTGCCTCGTGAAGG<br>ACTACTTTCCCGAGCCCGTGACCGTGTCCTGGAACTCTGGCGCTCTGACAAGCGGCGTGCACACCTTTCCAGCCGT<br>GCTCCAGAGCAGCGGCCTGTACTCTCTGAGCAGCGTCGTGACAGTGCCCAGCAGCAGCCTGGGCACCAAGACCTA<br>CACCTGTAACGTGGACCACAAGCCCAGCAACACCAAGGTGGACAAGCGGGTGGAATCTAAGTACGGCCCTCCCTG<br>CCCTCCTTGCCCAGCCCCTGAATTTCTGGGCGGACCCTCCGTGTTCCTGTTCCCCCCAAAGCCCAAGGACACCCTGA<br>TGATCAGCCGGACCCCCGAAGTGACCTGCGTGGTGGTGGATGTGTCCCAGGAAGATCCCGAGGTGCAGTTCAATT<br>GGTACGTGGACGGCGTGGAAGTGCACAACGCCAAGACCAAGCCCAGAGAGGAACAGTTCAACAGCACCTACCGG<br>GTGGTGTCCGTGCTGACCGTGCTGCACCAGGACTGGCTGAACGGCAAAGAGTACAAGTGCAAGGTGTCCAACAAG<br>GGCCTGCCCAGCTCCATCGAGAAAACCATCAGCAAGGCCAAGGGCCAGCCCCGCGAGCCTCAAGTGTATACCCTG<br>CCCCCTTGCCAGGAAGAGATGACCAAGAACCAGGTGTCCCTGTGGTGTCTCGTGAAAGGCTTCTACCCCAGCGACA<br>TTGCCGTGGAATGGGAGAGCAACGGCCAGCCCGAGAACAACTACAAGACCACCCCCCCTGTGCTGGACAGCGACG<br>GCTCATTCTTCCTGTACTCCAAGCTGACCGTGGACAAGAGCCGGTGGCAGGAAGGCAACGTGTTCAGCTGCTCCGT<br>GATGCACGAGGCCCTGCACAACCACTACACCCAGAAGTCCCTGTCTCTGTCCCTGGGC |
| | 4 | 216 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA |

TABLE 6-continued

| Trispecific binding protein polynucleotide sequences | | | |
|---|---|---|---|
| Molecule | Polypeptide Number (acc. to formula) | SEQ ID NO | Sequence |
| | | | AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| HER2-WT + trastuzumab/ CD28supxCD3mid (32/35QQ) L1 linker IgG4 FALA BP # 15 | 1 | 217 | GACATCGTGATGACCCAGACCCCCCTGAGCCTGAGCGTGACACCTGGACAGCCTGCCAGCATCAGCTGCAAGAGC AGCCAGAGCCTGGTGCACCAGAACGCCCAGACCTACCTGAGCTGGTATCTGCAGAAGCCCGGCCAGAGCCCCCAG TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGGCCAGCCCAAGGCCGCCCCCGACATCCAGATGACCCAGA GCCCCAGCAGCCTGTCTGCCAGCGTGGGCGACAGAGTGACCATCACCTGTCAGGCCAGCCAGAACATCTACGTGT GGCTGAACTGGTATCAGCAGAAGCCCGGCAAGGCCCCCAAGCTGCTGATCTACAAGGCCAGCAACCTGCACACCG GCGTGCCCAGCAGATTTTCTGGCAGCGGCTCCGGCACCGACTTCACCCTGACAATCAGCTCCCTGCAGCCCGAGGA CATTGCCACCTACTACTGCCAGCAGGGCCAGACCTACCCCTACACCTTTGGCCAGGGCACCAAGCTGGAAATCAAG ACCAAGGGCCCCAGCCGTACGGTGGCCGCTCCCAGCGTGTTCATCTTCCCACCTAGCGACGAGCAGCTGAAGTCCG GCACAGCCTCTGTCGTGTGCCTGCTGAACAACTTCTACCCCCGCGAGGCCAAAGTGCAGTGGAAGGTGGACAACG CCCTGCAGAGCGGCAACAGCCAGGAAAGCGTGACCGAGCAGGACAGCAAGGACTCCACCTACAGCCTGAGCAGC ACCCTGACACTGAGCAAGGCCGACTACGAGAAGCACAAGGTGTACGCCTGCGAAGTGACCCACCAGGGCCTGTCT AGCCCCGTGACCAAGAGCTTCAACCGGGGCGAGTGT |
| | 2 | 218 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCAGCCAGGTGCAGCTG GTGGAATCTGGCGGCGGAGTGGTGCAGCCTGGCAGAAGCCTGAGACTGAGCTGTGCCGCCAGCGGCTTCACCTTC ACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAA CACCCTGTACCTGCAGATGAACAGCCTGCGGGCCGAGGACACCGCCGTGTACTACTGTCGGGGCGTGTACTATGCC CTGAGCCCCTTCGATTACTGGGGCCAGGGAACCCTCGTGACCGTGTCTAGTCGGACCGCCAGCACAAAGGGCCCAT CGGTGTTCCCTCTGGCCCCTTGCAGCAGAAGCACCAGCGAATCTACAGCCGCCCTGGGCTGCCTCGTGAAGGACTA CTTTCCCGAGCCCGTGACCGTGTCCTGGAACTCTGGCGCTCTGACAAGCGGCGTGCACACCTTTCCAGCCGTGCTC CAGAGCAGCGGCCTGTACTCTCTGAGCAGCGTCGTGACAGTGCCCAGCAGCAGCCTGGGCACCAAGACCTACACC TGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGA TCAGCCGGACCCCCGAAGTGACCTGCGTGGTGGTGGATGTGTCCCAGGAAGATCCCGAGGTGCAGTTCAATTGGT ACGTGGACGGCGTGGAAGTGCACAACGCCAAGACCAAGCCCAGAGAGGAACAGTTCAACAGCACCTACCGGGTG GTGTCCGTGCTGACCGTGCTGCACCAGGACTGGCTGAACGGCAAAGAGTACAAGTGCAAGGTGTCCAACAAGGGC CTGCCCAGCTCCATCGAGAAAACCATCAGCAAGGCCAAGGGCCAGCCCCGCGAGCCTCAAGTGTGTACCCTGCCC CCTAGCCAGGAAGAGATGACCAAGAACCAGGTGTCCCTGAGCTGTGCCGTGAAAGGCTTCTACCCCAGCGACATT GCCGTGGAATGGGAGAGCAACGGCCAGCCCGAGAACAACTACAAGACCACCCCCCCTGTGCTGGACAGCGACGG |

TABLE 6-continued

Trispecific binding protein polynucleotide sequences

| Molecule | Polypeptide Number (acc. to formula) | SEQ ID NO | Sequence |
|---|---|---|---|
| | | | CTCATTCTTCCTGGTGTCCAAGCTGACCGTGGACAAGAGCCGGTGGCAGGAAGGCAACGTGTTCAGCTGCTCCGTG<br>ATGCACGAGGCCCTGCACAACCACTACACCCAGAAGTCCCTGTCTCTGTCCCTGGGC |
| | 3 | 219 | GAAGTGCAGCTGGTGGAATCTGGCGGCGGACTGGTGCAGCCTGGCGGATCTCTGAGACTGAGCTGTGCCGCCAGC<br>GGCTTCAACATCAAGGACACCTACATCCACTGGGTGCGCCAGGCCCCTGGCAAGGGACTGGAATGGGTGGCCAGA<br>ATCTACCCCACCAACGGCTACACCAGATACGCCGACAGCGTGAAGGGCCGGTTCACCATCAGCGCCGACACCAGC<br>AAGAACACCGCCTACCTGCAGATGAACAGCCTGCGGGCCGAGGACACCGCCGTGTACTACTGTAGTAGATGGGGA<br>GGCGACGGCTTCTACGCCATGGACTATTGGGGCCAGGGCACCCTCGTGACCGTGTCTAGTGCGTCGACCAAGGGCC<br>CATCGGTGTTCCCTCTGGCCCCTTGCAGCAGAAGCACCAGCGAATCTACAGCCGCCCTGGGCTGCCTCGTGAAGGA<br>CTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTAC<br>ACCTGTAACGTGGACCACAAGCCCAGCAACACCAAGGTGGACAAGCGGGTGGAATCTAAGTACGGCCCTCCCTGC<br>CCTCCTTGCCCAGCCCCTGAAGCTGCCGGCGGACCCTCCGTGTTCCTGTTCCCCCCAAAGCCCAAGGACACCCTGA<br>TGATCAGCCGGACCCCCGAAGTGACCTGCGTGGTGGTGGATGTGTCCCAGGAAGATCCCGAGGTGCAGTTCAATT<br>GGTACGTGGACGGCGTGGAAGTGCACAACGCCAAGACCAAGCCCAGAGAGGAACAGTTCAACAGCACCTACCGG<br>GTGGTGTCCGTGCTGACCGTGCTGCACCAGGACTGGCTGAACGGCAAAGAGTACAAGTGCAAGGTGTCCAACAAG<br>GGCCTGCCCAGCTCCATCGAGAAAACCATCAGCAAGGCCAAGGGCCAGCCCCGCGAGCCTCAAGTGTATACCCTG<br>CCCCCTTGCCAGGAAGAGATGACCAAGAACCAGGTGTCCCTGTGGTGTCTCGTGAAAGGCTTCTACCCCAGCGACA<br>TTGCCGTGGAATGGGAGAGCAACGGCCAGCCCGAGAACAACTACAAGACCACCCCCCCTGTGCTGGACAGCGACG<br>GCTCATTCTTCCTGTACTCCAAGCTGACCGTGGACAAGAGCCGGTGGCAGGAAGGCAACGTGTTCAGCTGCTCCGT<br>GATGCACGAGGCCCTGCACAACCACTACACCCAGAAGTCCCTGTCTCTGTCCCTGGGC |
| | 4 | 220 | GACATCCAGATGACCCAGAGCCCCAGCAGCCTGTCTGCCAGCGTGGGCGACAGAGTGACCATCACCTGTAGAGCC<br>AGCCAGGACGTGAACACCGCCGTGGCCTGGTATCAGCAGAAGCCTGGCAAGGCCCCCAAGCTGCTGATCTACAGC<br>GCCAGCTTCCTGTACAGCGGCGTGCCCAGCAGATTCAGCGGAAGCAGAAGCGGCACCGACTTCACCCTGACCATC<br>AGCTCCCTGCAGCCCGAGGACTTCGCCACCTACTACTGCCAGCAGCACTACACCACCCCCCCCACATTTGGCCAGG<br>GCACCAAGGTGGAAATCAAGCGTACGGTGGCCGCTCCCAGCGTGTTCATCTTCCCACCTAGCGACGAGCAGCTGA<br>AGTCCGGCACAGCCTCTGTCGTGTGCCTGCTGAACAACTTCTACCCCCGCGAGGCCAAAGTGCAGTGGAAGGTGG<br>ACAACGCCCTGCAGAGCGGCAACAGCCAGGAAAGCGTGACCGAGCAGGACAGCAAGGACTCCACCTACAGCCTG<br>AGCAGCACCCTGACACTGAGCAAGGCCGACTACGAGAAGCACAAGGTGTACGCCTGCGAAGTGACCCACCAGGG<br>CCTGTCTAGCCCCGTGACCAAGAGCTTCAACCGGGGCGAGTGT |
| HER2/<br>$CD28_{sup}xCD3_{mid}$<br>DKTHT linkers<br>on HC/LC) IgG4<br>FALA<br>BP #25 | 1 | 221 | GACATCGTGATGACCCAGACCCCCCTGAGCCTGAGCGTGACACCTGGACAGCCTGCCAGCATCAGCTGCAAGAGC<br>AGCCAGAGCCTGGTGCACAACAACGCCAACACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |

TABLE 6-continued

Trispecific binding protein polynucleotide sequences

| Molecule | Polypeptide Number (acc. to formula) | SEQ ID NO | Sequence |
|---|---|---|---|
| | 2 | 222 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| | 3 | 223 | GAAGTGCAGCTGGTGGAATCTGGCGGCGGACTGGTGCAGCCTGGCGGATCTCTGAGACTGAGCTGTGCCGCCAGC<br>GGCTTCAACATCAAGGACACCTACATCCACTGGGTGCGCCAGGCCCCTGGCAAGGGACTGGAATGGGTGGCCAGA<br>ATCTACCCCACCAACGGCTACACCAGATACGCCGACAGCGTGAAGGGCCGGTTCACCATCAGCGCCGACACCAGC<br>AAGAACACCGCCTACCTGCAGATGAACAGCCTGCGGGCCGAGGACACCGCCGTGTACTACTGTAGTAGATGGGGA<br>GGCGACGGCTTCTACGCCATGGACTATTGGGGCCAGGGCACCCTCGTGACCGTGTCTAGTGCGTCGACCAAGGGCC<br>CATCGGTGTTCCCTCTGGCCCCTTGCAGCAGAAGCACCAGCGAATCTACAGCCGCCCTGGGCTGCCTCGTGAAGGA<br>CTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTAC<br>ACCTGTAACGTGGACCACAAGCCCAGCAACACCAAGGTGGACAAGCGGGTGGAATCTAAGTACGGCCCTCCCTGC<br>CCTCCTTGCCCAGCCCCTGAAGCTGCCGGCGGACCCTCCGTGTTCCTGTTCCCCCCAAAGCCCAAGGACACCCTGA<br>TGATCAGCCGGACCCCCGAAGTGACCTGCGTGGTGGTGGATGTGTCCCAGGAAGATCCCGAGGTGCAGTTCAATT<br>GGTACGTGGACGGCGTGGAAGTGCACAACGCCAAGACCAAGCCCAGAGAGGAACAGTTCAACAGCACCTACCGG<br>GTGGTGTCCGTGCTGACCGTGCTGCACCAGGACTGGCTGAACGGCAAAGAGTACAAGTGCAAGGTGTCCAACAAG<br>GGCCTGCCCAGCTCCATCGAGAAAACCATCAGCAAGGCCAAGGGCCAGCCCCGCGAGCCTCAAGTGTATACCCTG<br>CCCCCTTGCCAGGAAGAGATGACCAAGAACCAGGTGTCCCTGTGGTGTCTCGTGAAAGGCTTCTACCCCAGCGACA<br>TTGCCGTGGAATGGGAGAGCAACGGCCAGCCCGAGAACAACTACAAGACCACCCCCCCTGTGCTGGACAGCGACG<br>GCTCATTCTTCCTGTACTCCAAGCTGACCGTGGACAAGAGCCGGTGGCAGGAAGGCAACGTGTTCAGCTGCTCCGT<br>GATGCACGAGGCCCTGCACAACCACTACACCCAGAAGTCCCTGTCTCTGTCCCTGGGC |
| | 4 | 224 | GACATCCAGATGACCCAGAGCCCCAGCAGCCTGTCTGCCAGCGTGGGCGACAGAGTGACCATCACCTGTAGAGCC<br>AGCCAGGACGTGAACACCGCCGTGGCCTGGTATCAGCAGAAGCCTGGCAAGGCCCCCAAGCTGCTGATCTACAGC |

TABLE 6-continued

| Trispecific binding protein polynucleotide sequences | | | |
|---|---|---|---|
| Molecule | Polypeptide Number (acc. to formula) | SEQ ID NO | Sequence |
| | | | GCCAGCTTCCTGTACAGCGGCGTGCCCAGCAGATTCAGCGGAAGCAGAAGCGGCACCGACTTCACCCTGACCATC AGCTCCCTGCAGCCCGAGGACTTCGCCACCTACTACTGCCAGCAGCACTACACCACCCCCCCCACATTTGGCCAGG GCACCAAGGTGGAAATCAAGCGTACGGTGGCCGCTCCCAGCGTGTTCATCTTCCCACCTAGCGACGAGCAGCTGA AGTCCGGCACAGCCTCTGTCGTGTGCCTGCTGAACAACTTCTACCCCCGCGAGGCCAAAGTGCAGTGGAAGGTGG ACAACGCCCTGCAGAGCGGCAACAGCCAGGAAAGCGTGACCGAGCAGGACAGCAAGGACTCCACCTACAGCCTG AGCAGCACCCTGACACTGAGCAAGGCCGACTACGAGAAGCACAAGGTGTACGCCTGCGAAGTGACCCACCAGGG CCTGTCTAGCCCCGTGACCAAGAGCTTCAACCGGGGCGAGTGT |
| HER2/ CD28$_{sup}$xCD3$_{mid}$ (32/33/3435 ENLR (LC); DKTHT linkers on HC/LC) IgG4 FALA BP #26 | 1 | 225 | GACATCGTGATGACCCAGACCCCCCTGAGCCTGAGCGTGACACCTGGACAGCCTGCCAGCATCAGCTGCAAGAGC AGCCAGAGCCTGGTGCACGAGAACCTGCGTACCTACCTGAGCTGGTATCTGCAGAAGCCCGGCCAGAGCCCCCAG TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGACAAAACCCATACCGACATCCAGATGACCCAGAGCCCCA GCAGCCTGTCTGCCAGCGTGGGCGACAGAGTGACCATCACCTGTCAGGCCAGCCAGAACATCTACGTGTGGCTGA ACTGGTATCAGCAGAAGCCCGGCAAGGCCCCCAAGCTGCTGATCTACAAGGCCAGCAACCTGCACACCGGCGTGC CCAGCAGATTTTCTGGCAGCGGCTCCGGCACCGACTTCACCCTGACAATCAGCTCCCTGCAGCCCGAGGACATTGC CACCTACTACTGCCAGCAGGGCCAGACCTACCCCTACACCTTTGGCCAGGGCACCAAGCTGGAAATCAAGGATAA GACCCACACCCGTACGGTGGCCGCTCCCAGCGTGTTCATCTTCCCACCTAGCGACGAGCAGCTGAAGTCCGGCACA GCCTCTGTCGTGTGCCTGCTGAACAACTTCTACCCCCGCGAGGCCAAAGTGCAGTGGAAGGTGGACAACGCCCTGC AGAGCGGCAACAGCCAGGAAAGCGTGACCGAGCAGGACAGCAAGGACTCCACCTACAGCCTGAGCAGCACCCTG ACACTGAGCAAGGCCGACTACGAGAAGCACAAGGTGTACGCCTGCGAAGTGACCCACCAGGGCCTGTCTAGCCCC GTGACCAAGAGCTTCAACCGGGGCGAGTGT |
| | 2 | 226 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |

TABLE 6-continued

| Trispecific binding protein polynucleotide sequences | | | |
|---|---|---|---|
| Molecule | Polypeptide Number (acc. to formula) | SEQ ID NO | Sequence |
| | 3 | 227 | GAAGTGCAGCTGGTGGAATCTGGCGGCGGACTGGTGCAGCCTGGCGGATCTCTGAGACTGAGCTGTGCCGCCAGC<br>GGCTTCAACATCAAGGACACCTACATCCACTGGGTGCGCCAGGCCCCTGGCAAGGGACTGGAATGGGTGGCCAGA<br>ATCTACCCCACCAACGGCTACACCAGATACGCCGACAGCGTGAAGGGCCGGTTCACCATCAGCGCCGACACCAGC<br>AAGAACACCGCCTACCTGCAGATGAACAGCCTGCGGGCCGAGGACACCGCCGTGTACTACTGTAGTAGATGGGGA<br>GGCGACGGCTTCTACGCCATGGACTATTGGGGCCAGGGCACCCTCGTGACCGTGTCTAGTGCGTCGACCAAGGGCC<br>CATCGGTGTTCCCTCTGGCCCCTTGCAGCAGAAGCACCAGCGAATCTACAGCCGCCCTGGGCTGCCTCGTGAAGGA<br>CTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTAC<br>ACCTGTAACGTGGACCACAAGCCCAGCAACACCAAGGTGGACAAGCGGGTGGAATCTAAGTACGGCCCTCCCTGC<br>CCTCCTTGCCCAGCCCCTGAAGCTGCCGGCGGACCCTCCGTGTTCCTGTTCCCCCCAAAGCCCAAGGACACCCTGA<br>TGATCAGCCGGACCCCCGAAGTGACCTGCGTGGTGGTGGATGTGTCCCAGGAAGATCCCGAGGTGCAGTTCAATT<br>GGTACGTGGACGGCGTGGAAGTGCACAACGCCAAGACCAAGCCCAGAGAGGAACAGTTCAACAGCACCTACCGG<br>GTGGTGTCCGTGCTGACCGTGCTGCACCAGGACTGGCTGAACGGCAAAGAGTACAAGTGCAAGGTGTCCAACAAG<br>GGCCTGCCCAGCTCCATCGAGAAAACCATCAGCAAGGCCAAGGGCCAGCCCCGCGAGCCTCAAGTGTATACCCTG<br>CCCCCTTGCCAGGAAGAGATGACCAAGAACCAGGTGTCCCTGTGGTGTCTCGTGAAAGGCTTCTACCCCAGCGACA<br>TTGCCGTGGAATGGGAGAGCAACGGCCAGCCCGAGAACAACTACAAGACCACCCCCCCTGTGCTGGACAGCGACG<br>GCTCATTCTTCCTGTACTCCAAGCTGACCGTGGACAAGAGCCGGTGGCAGGAAGGCAACGTGTTCAGCTGCTCCGT<br>GATGCACGAGGCCCTGCACAACCACTACACCCAGAAGTCCCTGTCTCTGTCCCTGGGC |
| | 4 | 228 | GACATCCAGATGACCCAGAGCCCCAGCAGCCTGTCTGCCAGCGTGGGCGACAGAGTGACCATCACCTGTAGAGCC<br>AGCCAGGACGTGAACACCGCCGTGGCCTGGTATCAGCAGAAGCCTGGCAAGGCCCCCAAGCTGCTGATCTACAGC<br>GCCAGCTTCCTGTACAGCGGCGTGCCCAGCAGATTCAGCGGAAGCAGAAGCGGCACCGACTTCACCCTGACCATC<br>AGCTCCCTGCAGCCCGAGGACTTCGCCACCTACTACTGCCAGCAGCACTACACCACCCCCCCCACATTTGGCCAGG<br>GCACCAAGGTGGAAATCAAGCGTACGGTGGCCGCTCCCAGCGTGTTCATCTTCCCACCTAGCGACGAGCAGCTGA<br>AGTCCGGCACAGCCTCTGTCGTGTGCCTGCTGAACAACTTCTACCCCCGCGAGGCCAAAGTGCAGTGGAAGGTGG<br>ACAACGCCCTGCAGAGCGGCAACAGCCAGGAAAGCGTGACCGAGCAGGACAGCAAGGACTCCACCTACAGCCTG<br>AGCAGCACCCTGACACTGAGCAAGGCCGACTACGAGAAGCACAAGGTGTACGCCTGCGAAGTGACCCACCAGGG<br>CCTGTCTAGCCCCGTGACCAAGAGCTTCAACCGGGGCGAGTGT |
| HER2/ $CD28_{sup}xCD3_{mid}$ (32/33/3435 ENLQ (LC); DKTHT linkers on HC/LC) IgG4 FALA BP #27 | 1 | 229 | GACATCGTGATGACCCAGACCCCCCTGAGCCTGAGCGTGACACCTGGACAGCCTGCCAGCATCAGCTGCAAGAGC<br>AGCCAGAGCCTGGTGCACGAGAACCTGCAGACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |
| | 2 | 230 | CAGGTGCAGCTGGTGCAGTCTGGCGCCGAGGTCGTGAAACCTGGCGCCTCTGTGAAGGTGTCCTGCAAGGCCAGC |

TABLE 6-continued

| Trispecific binding protein polynucleotide sequences | | | |
|---|---|---|---|
| Molecule | Polypeptide Number (acc. to formula) | SEQ ID NO | Sequence |
| | | | GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 231 | GAAGTGCAGCTGGTGGAATCTGGCGGCGGACTGGTGCAGCCTGGCGGATCTCTGAGACTGAGCTGTGCCGCCAGC GGCTTCAACATCAAGGACACCTACATCCACTGGGTGCGCCAGGCCCCTGGCAAGGGACTGGAATGGGTGGCCAGA ATCTACCCCACCAACGGCTACACCAGATACGCCGACAGCGTGAAGGGCCGGTTCACCATCAGCGCCGACACCAGC AAGAACACCGCCTACCTGCAGATGAACAGCCTGCGGGCCGAGGACACCGCCGTGTACTACTGTAGTAGATGGGGA GGCGACGGCTTCTACGCCATGGACTATTGGGGCCAGGGCACCCTCGTGACCGTGTCTAGTGCGTCGACCAAGGGCC CATCGGTGTTCCCTCTGGCCCCTTGCAGCAGAAGCACCAGCGAATCTACAGCCGCCCTGGGCTGCCTCGTGAAGGA CTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTAC ACCTGTAACGTGGACCACAAGCCCAGCAACACCAAGGTGGACAAGCGGGTGGAATCTAAGTACGGCCCTCCCTGC CCTCCTTGCCCAGCCCCTGAAGCTGCCGGCGGACCCTCCGTGTTCCTGTTCCCCCCAAAGCCCAAGGACACCCTGA TGATCAGCCGGACCCCCGAAGTGACCTGCGTGGTGGTGGATGTGTCCCAGGAAGATCCCGAGGTGCAGTTCAATT GGTACGTGGACGGCGTGGAAGTGCACAACGCCAAGACCAAGCCCAGAGAGGAACAGTTCAACAGCACCTACCGG GTGGTGTCCGTGCTGACCGTGCTGCACCAGGACTGGCTGAACGGCAAAGAGTACAAGTGCAAGGTGTCCAACAAG GGCCTGCCCAGCTCCATCGAGAAAACCATCAGCAAGGCCAAGGGCCAGCCCCGCGAGCCTCAAGTGTATACCCTG CCCCCTTGCCAGGAAGAGATGACCAAGAACCAGGTGTCCCTGTGGTGTCTCGTGAAAGGCTTCTACCCCAGCGACA TTGCCGTGGAATGGGAGAGCAACGGCCAGCCCGAGAACAACTACAAGACCACCCCCCCTGTGCTGGACAGCGACG GCTCATTCTTCCTGTACTCCAAGCTGACCGTGGACAAGAGCCGGTGGCAGGAAGGCAACGTGTTCAGCTGCTCCGT GATGCACGAGGCCCTGCACAACCACTACACCCAGAAGTCCCTGTCTCTGTCCCTGGGC |
| | 4 | 232 | GACATCCAGATGACCCAGAGCCCCAGCAGCCTGTCTGCCAGCGTGGGCGACAGAGTGACCATCACCTGTAGAGCC AGCCAGGACGTGAACACCGCCGTGGCCTGGTATCAGCAGAAGCCTGGCAAGGCCCCCAAGCTGCTGATCTACAGC GCCAGCTTCCTGTACAGCGGCGTGCCCAGCAGATTCAGCGGAAGCAGAAGCGGCACCGACTTCACCCTGACCATC AGCTCCCTGCAGCCCGAGGACTTCGCCACCTACTACTGCCAGCAGCACTACACCACCCCCCCCACATTTGGCCAGG |

TABLE 6-continued

Trispecific binding protein polynucleotide sequences

| Molecule | Polypeptide Number (acc. to formula) | SEQ ID NO | Sequence |
| --- | --- | --- | --- |
| | | | GCACCAAGGTGGAAATCAAGCGTACGGTGGCCGCTCCCAGCGTGTTCATCTTCCCACCTAGCGACGAGCAGCTGA AGTCCGGCACAGCCTCTGTCGTGTGCCTGCTGAACAACTTCTACCCCCGCGAGGCCAAAGTGCAGTGGAAGGTGG ACAACGCCCTGCAGAGCGGCAACAGCCAGGAAAGCGTGACCGAGCAGGACAGCAAGGACTCCACCTACAGCCTG AGCAGCACCCTGACACTGAGCAAGGCCGACTACGAGAAGCACAAGGTGTACGCCTGCGAAGTGACCCACCAGGG CCTGTCTAGCCCCGTGACCAAGAGCTTCAACCGGGGCGAGTGT |
| HER2/ $CD28_{sup}xCD3_{mid}$ (32/33/3435 ENLF (LC); DKTHT linkers on HC/LC) IgG4 FALA BP #28 | 1 | 233 | GACATCGTGATGACCCAGACCCCCCTGAGCCTGAGCGTGACACCTGGACAGCCTGCCAGCATCAGCTGCAAGAGC AGCCAGAGCCTGGTGCACGAGAACCTGTTCACCTACCTGAGCTGGTATCTGCAGAAGCCCGGCCAGAGCCCCCAG TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGACAAAACCCATACCGACATCCAGATGACCCAGAGCCCCA GCAGCCTGTCTGCCAGCGTGGGCGACAGAGTGACCATCACCTGTCAGGCCAGCCAGAACATCTACGTGTGGCTGA ACTGGTATCAGCAGAAGCCCGGCAAGGCCCCCAAGCTGCTGATCTACAAGGCCAGCAACCTGCACACCGGCGTGC CCAGCAGATTTTCTGGCAGCGGCTCCGGCACCGACTTCACCCTGACAATCAGCTCCCTGCAGCCCGAGGACATTGC CACCTACTACTGCCAGCAGGGCCAGACCTACCCCTACACCTTTGGCCAGGGCACCAAGCTGGAAATCAAGGATAA GACCCACACCCGTACGGTGGCCGCTCCCAGCGTGTTCATCTTCCCACCTAGCGACGAGCAGCTGAAGTCCGGCACA GCCTCTGTCGTGTGCCTGCTGAACAACTTCTACCCCCGCGAGGCCAAAGTGCAGTGGAAGGTGGACAACGCCCTGC AGAGCGGCAACAGCCAGGAAAGCGTGACCGAGCAGGACAGCAAGGACTCCACCTACAGCCTGAGCAGCACCCTG ACACTGAGCAAGGCCGACTACGAGAAGCACAAGGTGTACGCCTGCGAAGTGACCCACCAGGGCCTGTCTAGCCCC GTGACCAAGAGCTTCAACCGGGGCGAGTGT |
| | 2 | 234 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 235 | GAAGTGCAGCTGGTGGAATCTGGCGGCGGACTGGTGCAGCCTGGCGGATCTCTGAGACTGAGCTGTGCCGCCAGC |

TABLE 6-continued

| Trispecific binding protein polynucleotide sequences | | | |
|---|---|---|---|
| Molecule | Polypeptide Number (acc. to formula) | SEQ ID NO | Sequence |
| | | | GGCTTCAACATCAAGGACACCTACATCCACTGGGTGCGCCAGGCCCCTGGCAAGGGACTGGAATGGGTGGCCAGA<br>ATCTACCCCACCAACGGCTACACCAGATACGCCGACAGCGTGAAGGGCCGGTTCACCATCAGCGCCGACACCAGC<br>AAGAACACCGCCTACCTGCAGATGAACAGCCTGCGGGCCGAGGACACCGCCGTGTACTACTGTAGTAGATGGGGA<br>GGCGACGGCTTCTACGCCATGGACTATTGGGGCCAGGGCACCCTCGTGACCGTGTCTAGTGCGTCGACCAAGGGCC<br>CATCGGTGTTCCCTCTGGCCCCTTGCAGCAGAAGCACCAGCGAATCTACAGCCGCCCTGGGCTGCCTCGTGAAGGA<br>CTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTAC<br>ACCTGTAACGTGGACCACAAGCCCAGCAACACCAAGGTGGACAAGCGGGTGGAATCTAAGTACGGCCCTCCCTGC<br>CCTCCTTGCCCAGCCCCTGAAGCTGCCGGCGGACCCTCCGTGTTCCTGTTCCCCCCAAAGCCCAAGGACACCCTGA<br>TGATCAGCCGGACCCCCGAAGTGACCTGCGTGGTGGTGGATGTGTCCCAGGAAGATCCCGAGGTGCAGTTCAATT<br>GGTACGTGGACGGCGTGGAAGTGCACAACGCCAAGACCAAGCCCAGAGAGGAACAGTTCAACAGCACCTACCGG<br>GTGGTGTCCGTGCTGACCGTGCTGCACCAGGACTGGCTGAACGGCAAAGAGTACAAGTGCAAGGTGTCCAACAAG<br>GGCCTGCCCAGCTCCATCGAGAAAACCATCAGCAAGGCCAAGGGCCAGCCCCGCGAGCCTCAAGTGTATACCCTG<br>CCCCCTTGCCAGGAAGAGATGACCAAGAACCAGGTGTCCCTGTGGTGTCTCGTGAAAGGCTTCTACCCCAGCGACA<br>TTGCCGTGGAATGGGAGAGCAACGGCCAGCCCGAGAACAACTACAAGACCACCCCCCCTGTGCTGGACAGCGACG<br>GCTCATTCTTCCTGTACTCCAAGCTGACCGTGGACAAGAGCCGGTGGCAGGAAGGCAACGTGTTCAGCTGCTCCGT<br>GATGCACGAGGCCCTGCACAACCACTACACCCAGAAGTCCCTGTCTCTGTCCCTGGGC |
| | 4 | 236 | GACATCCAGATGACCCAGAGCCCCAGCAGCCTGTCTGCCAGCGTGGGCGACAGAGTGACCATCACCTGTAGAGCC<br>AGCCAGGACGTGAACACCGCCGTGGCCTGGTATCAGCAGAAGCCTGGCAAGGCCCCCAAGCTGCTGATCTACAGC<br>GCCAGCTTCCTGTACAGCGGCGTGCCCAGCAGATTCAGCGGAAGCAGAAGCGGCACCGACTTCACCCTGACCATC<br>AGCTCCCTGCAGCCCGAGGACTTCGCCACCTACTACTGCCAGCAGCACTACACCACCCCCCCCACATTTGGCCAGG<br>GCACCAAGGTGGAAATCAAGCGTACGGTGGCCGCTCCCAGCGTGTTCATCTTCCCACCTAGCGACGAGCAGCTGA<br>AGTCCGGCACAGCCTCTGTCGTGTGCCTGCTGAACAACTTCTACCCCCGCGAGGCCAAAGTGCAGTGGAAGGTGG<br>ACAACGCCCTGCAGAGCGGCAACAGCCAGGAAAGCGTGACCGAGCAGGACAGCAAGGACTCCACCTACAGCCTG<br>AGCAGCACCCTGACACTGAGCAAGGCCGACTACGAGAAGCACAAGGTGTACGCCTGCGAAGTGACCCACCAGGG<br>CCTGTCTAGCCCCGTGACCAAGAGCTTCAACCGGGGCGAGTGT |
| anti-Her2/CD3/3CD28 IgG4 FALA BP #29 | 1 | 237 | GACATCGTGATGACCCAGACCCCCCTGAGCCTGAGCGTGACACCTGGACAGCCTGCCAGCATCAGCTGCAAGAGC<br>AGCCAGAGCCTGGTGCACAACAACGCCAACACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGGCCAGCCCAAGGCCGCCCCCGACATCCAGATGACCCAGA<br>GCCCCAGCAGCCTGTCTGCCAGCGTGGGCGACAGAGTGACCATCACCTGTCAGGCCAGCCAGAACATCTACGTGT<br>GGCTGAACTGGTATCAGCAGAAGCCCGGCAAGGCCCCCAAGCTGCTGATCTACAAGGCCAGCAACCTGCACACCG<br>GCGTGCCCAGCAGATTTTCTGGCAGCGGCTCCGGCACCGACTTCACCCTGACAATCAGCTCCCTGCAGCCCGAGGA<br>CATTGCCACCTACTACTGCCAGCAGGGCCAGACCTACCCCTACACCTTTGGCCAGGGCACCAAGCTGGAAATCAAG<br>ACCAAGGGCCCCAGCCGTACGGTGGCCGCTCCCAGCGTGTTCATCTTCCCACCTAGCGACGAGCAGCTGAAGTCCG<br>GCACAGCCTCTGTCGTGTGCCTGCTGAACAACTTCTACCCCCGCGAGGCCAAAGTGCAGTGGAAGGTGGACAACG<br>CCCTGCAGAGCGGCAACAGCCAGGAAAGCGTGACCGAGCAGGACAGCAAGGACTCCACCTACAGCCTGAGCAGC<br>ACCCTGACACTGAGCAAGGCCGACTACGAGAAGCACAAGGTGTACGCCTGCGAAGTGACCCACCAGGGCCTGTCT<br>AGCCCCGTGACCAAGAGCTTCAACCGGGGCGAGTGT |
| | 2 | 238 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC |

TABLE 6-continued

Trispecific binding protein polynucleotide sequences

| Molecule | Polypeptide Number (acc. to formula) | SEQ ID NO | Sequence |
|---|---|---|---|
| | | | ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCAGCCAGGTGCAGCTG GTGGAATCTGGCGGCGGAGTGGTGCAGCCTGGCAGAAGCCTGAGACTGAGCTGTGCCGCCAGCGGCTTCACCTTC ACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAA CACCCTGTACCTGCAGATGAACAGCCTGCGGGCCGAGGACACCGCCGTGTACTACTGTCGGGGCGTGTACTATGCC CTGAGCCCCTTCGATTACTGGGGCCAGGGAACCCTCGTGACCGTGTCTAGTCGGACCGCCAGCACAAAGGGCCCAT CGGTGTTCCCTCTGGCCCCTTGCAGCAGAAGCACCAGCGAATCTACAGCCGCCCTGGGCTGCCTCGTGAAGGACTA CTTTCCCGAGCCCGTGACCGTGTCCTGGAACTCTGGCGCTCTGACAAGCGGCGTGCACACCTTTCCAGCCGTGCTC CAGAGCAGCGGCCTGTACTCTCTGAGCAGCGTCGTGACAGTGCCCAGCAGCAGCCTGGGCACCAAGACCTACACC TGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGA TCAGCCGGACCCCCGAAGTGACCTGCGTGGTGGTGGATGTGTCCCAGGAAGATCCCGAGGTGCAGTTCAATTGGT ACGTGGACGGCGTGGAAGTGCACAACGCCAAGACCAAGCCCAGAGAGGAACAGTTCAACAGCACCTACCGGGTG GTGTCCGTGCTGACCGTGCTGCACCAGGACTGGCTGAACGGCAAAGAGTACAAGTGCAAGGTGTCCAACAAGGGC CTGCCCAGCTCCATCGAGAAAACCATCAGCAAGGCCAAGGGCCAGCCCCGCGAGCCTCAAGTGTGTACCCTGCCC CCTAGCCAGGAAGAGATGACCAAGAACCAGGTGTCCCTGAGCTGTGCCGTGAAAGGCTTCTACCCCAGCGACATT GCCGTGGAATGGGAGAGCAACGGCCAGCCCGAGAACAACTACAAGACCACCCCCCCTGTGCTGGACAGCGACGG CTCATTCTTCCTGGTGTCCAAGCTGACCGTGGACAAGAGCCGGTGGCAGGAAGGCAACGTGTTCAGCTGCTCCGTG ATGCACGAGGCCCTGCACAACCACTACACCCAGAAGTCCCTGTCTCTGTCCCTGGGC |
| | 3 | 239 | GAAGTGCAGCTGGTGGAATCTGGCGGCGGACTGGTGCAGCCTGGCGGATCTCTGAGACTGAGCTGTGCCGCCAGC GGCTTCAACATCAAGGACACCTACATCCACTGGGTGCGCCAGGCCCCTGGCAAGGGACTGGAATGGGTGGCCAGA ATCTACCCCACCAACGGCTACACCAGATACGCCGACAGCGTGAAGGGCCGGTTCACCATCAGCGCCGACACCAGC AAGAACACCGCCTACCTGCAGATGAACAGCCTGCGGGCCGAGGACACCGCCGTGTACTACTGTAGTAGATGGGGA GGCGACGGCTTCTACGCCATGGACTATTGGGGCCAGGGCACCCTCGTGACCGTGTCTAGTGCGTCGACCAAGGGCC CATCGGTGTTCCCTCTGGCCCCTTGCAGCAGAAGCACCAGCGAATCTACAGCCGCCCTGGGCTGCCTCGTGAAGGA CTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTAC ACCTGTAACGTGGACCACAAGCCCAGCAACACCAAGGTGGACAAGCGGGTGGAATCTAAGTACGGCCCTCCCTGC CCTCCTTGCCCAGCCCCTGAAGCTGCCGGCGGACCCTCCGTGTTCCTGTTCCCCCCAAAGCCCAAGGACACCCTGA TGATCAGCCGGACCCCCGAAGTGACCTGCGTGGTGGTGGATGTGTCCCAGGAAGATCCCGAGGTGCAGTTCAATT GGTACGTGGACGGCGTGGAAGTGCACAACGCCAAGACCAAGCCCAGAGAGGAACAGTTCAACAGCACCTACCGG GTGGTGTCCGTGCTGACCGTGCTGCACCAGGACTGGCTGAACGGCAAAGAGTACAAGTGCAAGGTGTCCAACAAG GGCCTGCCCAGCTCCATCGAGAAAACCATCAGCAAGGCCAAGGGCCAGCCCCGCGAGCCTCAAGTGTATACCCTG CCCCCTTGCCAGGAAGAGATGACCAAGAACCAGGTGTCCCTGTGGTGTCTCGTGAAAGGCTTCTACCCCAGCGACA TTGCCGTGGAATGGGAGAGCAACGGCCAGCCCGAGAACAACTACAAGACCACCCCCCCTGTGCTGGACAGCGACG GCTCATTCTTCCTGTACTCCAAGCTGACCGTGGACAAGAGCCGGTGGCAGGAAGGCAACGTGTTCAGCTGCTCCGT GATGCACGAGGCCCTGCACAACCACTACACCCAGAAGTCCCTGTCTCTGTCCCTGGGC |
| | 4 | 240 | GACATCCAGATGACCCAGAGCCCCAGCAGCCTGTCTGCCAGCGTGGGCGACAGAGTGACCATCACCTGTAGAGCC AGCCAGGACGTGAACACCGCCGTGGCCTGGTATCAGCAGAAGCCTGGCAAGGCCCCCAAGCTGCTGATCTACAGC GCCAGCTTCCTGTACAGCGGCGTGCCCAGCAGATTCAGCGGAAGCAGAAGCGGCACCGACTTCACCCTGACCATC AGCTCCCTGCAGCCCGAGGACTTCGCCACCTACTACTGCCAGCAGCACTACACCACCCCCCCCACATTTGGCCAGG GCACCAAGGTGGAAATCAAGCGTACGGTGGCCGCTCCCAGCGTGTTCATCTTCCCACCTAGCGACGAGCAGCTGA AGTCCGGCACAGCCTCTGTCGTGTGCCTGCTGAACAACTTCTACCCCCGCGAGGCCAAAGTGCAGTGGAAGGTGG |

TABLE 6-continued

| Trispecific binding protein polynucleotide sequences | | | |
|---|---|---|---|
| Molecule | Polypeptide Number (acc. to formula) | SEQ ID NO | Sequence |
| | | | ACAACGCCCTGCAGAGCGGCAACAGCCAGGAAAGCGTGACCGAGCAGGACAGCAAGGACTCCACCTACAGCCTG<br>AGCAGCACCCTGACACTGAGCAAGGCCGACTACGAGAAGCACAAGGTGTACGCCTGCGAAGTGACCCACCAGGG<br>CCTGTCTAGCCCCGTGACCAAGAGCTTCAACCGGGGCGAGTGT |
| HER230R/55Q/ 102E/ CD28$_{sup}$xCD3$_{mid}$ (32/33/3435 ENLR (LC); DKTHT linkers on HC/LC) IgG4 FALA BP #31 | 1 | 241 | GACATCGTGATGACCCAGACCCCCCTGAGCCTGAGCGTGACACCTGGACAGCCTGCCAGCATCAGCTGCAAGAGC<br>AGCCAGAGCCTGGTGCACGAGAACCTGCGTACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |
| | 2 | 242 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| | 3 | 243 | GAAGTGCAGCTGGTGGAATCTGGCGGCGGACTGGTGCAGCCTGGCGGATCTCTGAGACTGAGCTGTGCCGCCAGC<br>GGCTTCAACATCCGGGACACCTACATCCACTGGGTGCGCCAGGCCCCTGGCAAGGGACTGGAATGGGTGGCCAGA<br>ATCTACCCCACCCAGGGCTACACCAGATACGCCGACAGCGTGAAGGGCCGGTTCACCATCAGCGCCGACACCAGC |

TABLE 6-continued

| Molecule | Polypeptide Number (acc. to formula) | SEQ ID NO | Sequence |
|---|---|---|---|
| Trispecific binding protein polynucleotide sequences | | | |
| | | | AAGAACACCGCCTACCTGCAGATGAACAGCCTGCGGGCCGAGGACACCGCCGTGTACTACTGTAGTAGATGGGGA GGCGAAGGCTTCTACGCCATGGACTATTGGGGCCAGGGCACCCTCGTGACCGTGTCTAGTGCGTCGACCAAGGGC CCATCGGTGTTCCCTCTGGCCCCTTGCAGCAGAAGCACCAGCGAATCTACAGCCGCCCTGGGCTGCCTCGTGAAGG ACTACTTTCCCGAGCCCGTGACCGTGTCCTGGAACTCTGGCGCTCTGACAAGCGGCGTGCACACCTTTCCAGCCGT GCTCCAGAGCAGCGGCCTGTACTCTCTGAGCAGCGTCGTGACAGTGCCCAGCAGCAGCCTGGGCACCAAGACCTA CACCTGTAACGTGGACCACAAGCCCAGCAACACCAAGGTGGACAAGCGGGTGGAATCTAAGTACGGCCCTCCCTG CCCTCCTTGCCCAGCCCCTGAAGCTGCCGGCGGACCCTCCGTGTTCCTGTTCCCCCCAAAGCCCAAGGACACCCTG ATGATCAGCCGGACCCCCGAAGTGACCTGCGTGGTGGTGGATGTGTCCCAGGAAGATCCCGAGGTGCAGTTCAAT TGGTACGTGGACGGCGTGGAAGTGCACAACGCCAAGACCAAGCCCAGAGAGGAACAGTTCAACAGCACCTACCG GGTGGTGTCCGTGCTGACCGTGCTGCACCAGGACTGGCTGAACGGCAAAGAGTACAAGTGCAAGGTGTCCAACAA GGGCCTGCCCAGCTCCATCGAGAAAACCATCAGCAAGGCCAAGGGCCAGCCCCGCGAGCCTCAAGTGTATACCCT GCCCCCTTGCCAGGAAGAGATGACCAAGAACCAGGTGTCCCTGTGGTGTCTCGTGAAAGGCTTCTACCCCAGCGAC ATTGCCGTGGAATGGGAGAGCAACGGCCAGCCCGAGAACAACTACAAGACCACCCCCCCTGTGCTGGACAGCGAC GGCTCATTCTTCCTGTACTCCAAGCTGACCGTGGACAAGAGCCGGTGGCAGGAAGGCAACGTGTTCAGCTGCTCCG TGATGCACGAGGCCCTGCACAACCACTACACCCAGAAGTCCCTGTCTCTGTCCCTGGGC |
| | 4 | 244 | GACATCCAGATGACCCAGAGCCCCAGCAGCCTGTCTGCCAGCGTGGGCGACAGAGTGACCATCACCTGTAGAGCC AGCCAGGACGTGAACACCGCCGTGGCCTGGTATCAGCAGAAGCCTGGCAAGGCCCCCAAGCTGCTGATCTACAGC GCCAGCTTCCTGTACAGCGGCGTGCCCAGCAGATTCAGCGGAAGCAGAAGCGGCACCGACTTCACCCTGACCATC AGCTCCCTGCAGCCCGAGGACTTCGCCACCTACTACTGCCAGCAGCACTACACCACCCCCCCCACATTTGGCCAGG GCACCAAGGTGGAAATCAAGCGTACGGTGGCCGCTCCCAGCGTGTTCATCTTCCCACCTAGCGACGAGCAGCTGA AGTCCGGCACAGCCTCTGTCGTGTGCCTGCTGAACAACTTCTACCCCCGCGAGGCCAAAGTGCAGTGGAAGGTGG ACAACGCCCTGCAGAGCGGCAACAGCCAGGAAAGCGTGACCGAGCAGGACAGCAAGGACTCCACCTACAGCCTG AGCAGCACCCTGACACTGAGCAAGGCCGACTACGAGAAGCACAAGGTGTACGCCTGCGAAGTGACCCACCAGGG CCTGTCTAGCCCCGTGACCAAGAGCTTCAACCGGGGCGAGTGT |
| CD38VH1/ CD28sup x CD3mid_ENLQ DKTHT IgG4 FALA BP # 1 | 1 | 245 | GACATCGTGATGACCCAGACCCCCCTGAGCCTGAGCGTGACACCTGGACAGCCTGCCAGCATCAGCTGCAAGAGC AGCCAGAGCCTGGTGCACGAGAACCTGTTCACCTACCTGAGCTGGTATCTGCAGAAGCCCGGCCAGAGCCCCCAG TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGACAAAACCCATACCGACATCCAGATGACCCAGAGCCCCA GCAGCCTGTCTGCCAGCGTGGGCGACAGAGTGACCATCACCTGTCAGGCCAGCCAGAACATCTACGTGTGGCTGA ACTGGTATCAGCAGAAGCCCGGCAAGGCCCCCAAGCTGCTGATCTACAAGGCCAGCAACCTGCACACCGGCGTGC CCAGCAGATTTTCTGGCAGCGGCTCCGGCACCGACTTCACCCTGACAATCAGCTCCCTGCAGCCCGAGGACATTGC CACCTACTACTGCCAGCAGGGCCAGACCTACCCCTACACCTTTGGCCAGGGCACCAAGCTGGAAATCAAGGATAA GACCCACACCCGTACGGTGGCCGCTCCCAGCGTGTTCATCTTCCCACCTAGCGACGAGCAGCTGAAGTCCGGCACA GCCTCTGTCGTGTGCCTGCTGAACAACTTCTACCCCCGCGAGGCCAAAGTGCAGTGGAAGGTGGACAACGCCCTGC AGAGCGGCAACAGCCAGGAAAGCGTGACCGAGCAGGACAGCAAGGACTCCACCTACAGCCTGAGCAGCACCCTG ACACTGAGCAAGGCCGACTACGAGAAGCACAAGGTGTACGCCTGCGAAGTGACCCACCAGGGCCTGTCTAGCCCC GTGACCAAGAGCTTCAACCGGGGCGAGTGT |
| | 2 | 246 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC |

TABLE 6-continued

Trispecific binding protein polynucleotide sequences

| Molecule | Polypeptide Number (acc. to formula) | SEQ ID NO | Sequence |
|---|---|---|---|
| | | | CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 247 | CAGGTGCAGCTGGTGCAGTCTGGCGCCGAAGTCGTGAAACCTGGCGCCTCCGTGAAGGTGTCCTGCAAGGCCAGC GGCTACACCTTTACCAGCTACGCCATGCACTGGGTCAAAGAGGCCCCTGGCCAGAGACTGGAATGGATCGGCTAC ATCTACCCCGGCCAGGGCGGCACCAACTACAACCAGAAGTTCCAGGGCAGAGCCACCCTGACCGCCGATACAAGC GCCAGCACCGCCTACATGGAACTGAGCAGCCTGCGGAGCGAGGATACCGCCGTGTACTTCTGTGCCAGAACAGGC GGCCTGAGGCGGGCCTACTTTACCTATTGGGGCCAGGGCACCCTCGTGACCGTGTCTAGCGCTAGCACAAAGGGCC CATCGGTGTTCCCTCTGGCCCCTTGCAGCAGAAGCACCAGCGAATCTACAGCCGCCCTGGGCTGCCTCGTGAAGGA CTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTAC ACCTGTAACGTGGACCACAAGCCCAGCAACACCAAGGTGGACAAGCGGGTGGAATCTAAGTACGGCCCTCCCTGC CCTCCTTGCCCAGCCCCTGAAGCTGCCGGCGGACCCTCCGTGTTCCTGTTCCCCCCAAAGCCCAAGGACACCCTGA TGATCAGCCGGACCCCCGAAGTGACCTGCGTGGTGGTGGATGTGTCCCAGGAAGATCCCGAGGTGCAGTTCAATT GGTACGTGGACGGCGTGGAAGTGCACAACGCCAAGACCAAGCCCAGAGAGGAACAGTTCAACAGCACCTACCGG GTGGTGTCCGTGCTGACCGTGCTGCACCAGGACTGGCTGAACGGCAAAGAGTACAAGTGCAAGGTGTCCAACAAG GGCCTGCCCAGCTCCATCGAGAAAACCATCAGCAAGGCCAAGGGCCAGCCCCGCGAGCCTCAAGTGTATACCCTG CCCCCTTGCCAGGAAGAGATGACCAAGAACCAGGTGTCCCTGTGGTGTCTCGTGAAAGGCTTCTACCCCAGCGACA TTGCCGTGGAATGGGAGAGCAACGGCCAGCCCGAGAACAACTACAAGACCACCCCCCCTGTGCTGGACAGCGACG GCTCATTCTTCCTGTACTCCAAGCTGACCGTGGACAAGAGCCGGTGGCAGGAAGGCAACGTGTTCAGCTGCTCCGT GATGCACGAGGCCCTGCACAACCACTACACCCAGAAGTCCCTGTCTCTGTCCCTGGGC |
| | 4 | 248 | GACATCGTGCTGACACAGAGCCCTGCCACCCTGTCTCTGAGCCCTGGCGAGAGAGCCACCATCAGCTGTAGAGCC AGCCAGAGCGTGTCCAGCTACGGCCAGGGCTTCATGCACTGGTATCAGCAGAAGCCCGGCCAGCCCCCCAGACTG CTGATCTATGGCGCCAGCAGCAGAGCCACAGGCATCCCCGCCAGATTTTCTGGCTCTGGCAGCGGCACCGACTTCA CCCTGACAATCAGCCCCCTGGAACCCGAGGACTTCGCCGTGTACTACTGCCAGCAGAACAAAGAGGACCCCTGGA CCTTCGGCGGAGGCACCAAGCTGGAAATCAAGCGTACGGTGGCCGCTCCCAGCGTGTTCATCTTCCCACCTAGCGA CGAGCAGCTGAAGTCCGGCACAGCCTCTGTCGTGTGCCTGCTGAACAACTTCTACCCCCGCGAGGCCAAGGTGCAG TGGAAGGTGGACAATGCCCTGCAGAGCGGCAACAGCCAGGAAAGCGTGACCGAGCAGGACAGCAAGGACTCCAC CTACAGCCTGAGCAGCACCCTGACCCTGTCCAAGGCCGATTACGAGAAGCACAAGGTGTACGCCTGCGAAGTGAC |

TABLE 6-continued

Trispecific binding protein polynucleotide sequences

| Molecule | Polypeptide Number (acc. to formula) | SEQ ID NO | Sequence |
|---|---|---|---|
| | | | CCACCAGGGCCTGTCTAGCCCCGTGACCAAGAGCTTCAACCGGGGCGAGTGC |
| CD38hhy992/<br>CD28sup x<br>CD3mid_ENLQ<br>DKTHT IgG4<br>FALA<br>BP #5 | 1 | 249 | GACATCGTGATGACCCAGACCCCCCTGAGCCTGAGCGTGACACCTGGACAGCCTGCCAGCATCAGCTGCAAGAGC<br>AGCCAGAGCCTGGTGCACGAGAACCTGCAGACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |
| | 2 | 250 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| | 3 | 251 | CAGGTTCAGCTGGTTCAGTCTGGCGCCGAAGTGAAGAAACCTGGCGCCTCTGTGAAGGTGTCCTGCAAGGTGTCCG<br>GCTACACCCTGACCGAGTTCAGCATCCACTGGGTCCGACAGGCTCCAGGACAAGGCTTGGAATGGATGGGCGGCT<br>TCGATCCCGAGGACGGCGAAACAATCTACGCCCAGAAATTCCAGGGCCGCGTGATCATGACCGAGGACACCTCTA<br>CCGACACCGCCTACATGGAAATGAACAGCCTGCGGAGCGAGGATACCGCCATCTACTACTGTACCACCGGCAGAT<br>TCTTCGACTGGTTCTGGGGCCAGGGCACCCTGGTTACAGTCTCTTCTGCGTCGACCAAGGGCCCATCGGTGTTCCCT |

TABLE 6-continued

| Trispecific binding protein polynucleotide sequences | | | |
|---|---|---|---|
| Molecule | Polypeptide Number (acc. to formula) | SEQ ID NO | Sequence |
| | | | CTGGCCCCTTGCAGCAGAAGCACCAGCGAATCTACAGCCGCCCTGGGCTGCCTCGTGAAGGACTACTTTCCCGAGCCCGTGACCGTGTCCTGGAACTCTGGCGCTCTGACAAGCGGCGTGCACACCTTTCCAGCCGTGCTCCAGAGCAGCGGCCTGTACTCTCTGAGCAGCGTCGTGACAGTGCCCAGCAGCAGCCTGGGCACCAAGACCTACACCTGTAACGTGGACCACAAGCCCAGCAACACCAAGGTGGACAAGCGGGTGGAATCTAAGTACGGCCCTCCCTGCCCTCCTTGCCCAGCCCCTGAAGCTGCCGGCGGACCCTCCGTGTTCCTGTTCCCCCCAAAGCCCAAGGACACCCTGATGATCAGCCGGACCCCCGAAGTGACCTGCGTGGTGGTGGATGTGTCCCAGGAAGATCCCGAGGTGCAGTTCAATTGGTACGTGGACGGCGTGGAAGTGCACAACGCCAAGACCAAGCCCAGAGAGGAACAGTTCAACAGCACCTACCGGGTGGTGTCCGTGCTGACCGTGCTGCACCAGGACTGGCTGAACGGCAAAGAGTACAAGTGCAAGGTGTCCAACAAGGGCCTGCCCAGCTCCATCGAGAAAACCATCAGCAAGGCCAAGGGCCAGCCCCGCGAGCCTCAAGTGTATACCCTGCCCCCTTGCCAGGAAGAGATGACCAAGAACCAGGTGTCCCTGTGGTGTCTCGTGAAAGGCTTCTACCCCAGCGACATTGCCGTGGAATGGGAGAGCAACGGCCAGCCCGAGAACAACTACAAGACCACCCCCCCTGTGCTGGACAGCGACGGCTCATTCTTCCTGTACTCCAAGCTGACCGTGGACAAGAGCCGGTGGCAGGAAGGCAACGTGTTCAGCTGCTCCGTGATGCACGAGGCCCTGCACAACCACTACACCCAGAAGTCCCTGTCTCTGTCCCTGGGC |
| | 4 | 252 | GAGATCATCCTGACACAGAGCCCCGCCATCCTGTCACTGTCTCCAGGCGAAAGAGCCACACTGAGCTGTAGAGCCAGCCAGAGCGTGATCAGCAGATTCCTGAGCTGGTATCAAGTGAAGCCCGGACTGGCCCCTCGGCTGTTGATATATGGCGCCTCTACACGCGCCACAGGCATCCCTGTTAGATTTTCTGGCAGCGGCTCCGGCACCGACTTCAGCCTGACAATTAGCAGCCTGCAGCCTGAGGACTGCGCCGTGTACTACTGTCAGCAGGACAGCAACCTGCCTATCACCTTCGGCCAGGGCACCAGACTGGAAATCAAGCGTACGGTGGCCGCTCCCAGCGTGTTCATCTTCCCACCTAGCGACGAGCAGCTGAAGTCCGGCACAGCCTCTGTCGTGTGCCTGCTGAACAACTTCTACCCCCGCGAGGCCAAAGTGCAGTGGAAGGTGGACAACGCCCTGCAGAGCGGCAACAGCCAGGAAAGCGTGACCGAGCAGGACAGCAAGGACTCCACCTACAGCCTGAGCAGCACCCTGACACTGAGCAAGGCCGACTACGAGAAGCACAAGGTGTACGCCTGCGAAGTGACCCACCAGGGCCTGTCTAGCCCCGTGACCAAGAGCTTCAACCGGGGCGAGTGT |
| CD38hyb5739/ CD28sup x CD3mid_ENLQ DKTHT IgG4 FALA BP #6 | 1 | 253 | GACATCGTGATGACCCAGACCCCCCTGAGCCTGAGCGTGACACCTGGACAGCCTGCCAGCATCAGCTGCAAGAGCAGCCAGAGCCTGGTGCACGAGAACCTGCAGACCTACCTGAGCTGGTATCTGCAGAAGCCCGGCCAGAGCCCCCAGTCCCTGATCTACAAGGTGTCCAACAGATTCAGCGGCGTGCCCGACAGATTCTCCGGCAGCGGCTCTGGCACCGACTTCACCCTGAAGATCAGCCGGGTGGAAGCCGAGGACGTGGGCGTGTACTATTGTGGCCAGGGCACCCAGTACCCCTTCACCTTTGGCAGCGGCACCAAGGTGGAAATCAAGGACAAAACCCATACCGACATCCAGATGACCCAGAGCCCCAGCAGCCTGTCTGCCAGCGTGGGCGACAGAGTGACCATCACCTGTCAGGCCAGCCAGAACATCTACGTGTGGCTGAACTGGTATCAGCAGAAGCCCGGCAAGGCCCCCAAGCTGCTGATCTACAAGGCCAGCAACCTGCACACCGGCGTGCCCAGCAGATTTTCTGGCAGCGGCTCCGGCACCGACTTCACCCTGACAATCAGCTCCCTGCAGCCCGAGGACATTGCCACCTACTACTGCCAGCAGGGCCAGACCTACCCCTACACCTTTGGCCAGGGCACCAAGCTGGAAATCAAGGATAAGACCCACACCCGTACGGTGGCCGCTCCCAGCGTGTTCATCTTCCCACCTAGCGACGAGCAGCTGAAGTCCGGCACAGCCTCTGTCGTGTGCCTGCTGAACAACTTCTACCCCCGCGAGGCCAAAGTGCAGTGGAAGGTGGACAACGCCCTGCAGAGCGGCAACAGCCAGGAAAGCGTGACCGAGCAGGACAGCAAGGACTCCACCTACAGCCTGAGCAGCACCCTGACACTGAGCAAGGCCGACTACGAGAAGCACAAGGTGTACGCCTGCGAAGTGACCCACCAGGGCCTGTCTAGCCCCGTGACCAAGAGCTTCAACCGGGGCGAGTGT |
| | 2 | 254 | CAGGTGCAGCTGGTGCAGTCTGGCGCCGAGGTCGTGAAACCTGGCGCCTCTGTGAAGGTGTCCTGCAAGGCCAGCGGCTACACCTTTACCAGCTACTACATCCACTGGGTGCGCCAGGCCCCTGGACAGGGACTGGAATGGATCGGCAGCATCTACCCCGGCAACGTGAACACCAACTACGCCCAGAAGTTCCAGGGCAGAGCCACCCTGACCGTGGACACCAGCATCAGCACCGCCTACATGGAACTGAGCCGGCTGAGAAGCGACGACACCGCCGTGTACTACTGCACCCGGTCCCACTACGGCCTGGATTGGAACTTCGACGTGTGGGGCAAGGGCACCACCGTGACAGTGTCTAGCGACAAAACCCATACCCAGGTGCAGCTGGTGGAATCTGGCGGCGGAGTGGTGCAGCCTGGCAGAAGCCTGAGACTGAGCTGTGCCGCCAGCGGCTTCACCTTCACCAAGGCCTGGATGCACTGGGTGCGCCAGGCCCCTGGAAAGCAGCTGGAATGGGTGGCCCAG |

TABLE 6-continued

Trispecific binding protein polynucleotide sequences

| Molecule | Polypeptide Number (acc. to formula) | SEQ ID NO | Sequence |
|---|---|---|---|
| | | | ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 255 | CAGGTTCAGCTGCAGCAGTCTGGCCCCGAACTCGTTAGACCTGGCACCTCTGTGAAGGTGTCCTGCAAGGCCAGCG GCTACGCCTTTACCACCTACCTGGTGGAATGGATCAAGCAGAGGCCTGGACAGGGCCTCGAGTGGATCGGAGTGA TCAATCCTGGCAGCGGCAGCACCAACTACAACGAGAAGTTCAAGGGCAAAGCCACACTGACCGTGGACAGAAGC AGCACCACAGCCTACATGCACCTGAGCGGCCTGACCTCTGATGACAGCGCCGTGTACTTCTGCGCCAGATACGCCT ATGGCTATTGGGGCCAGGGCACAACCCTGACCGTTAGCTCTGCGTCGACCAAGGGCCCATCGGTGTTCCCTCTGGC CCCTTGCAGCAGAAGCACCAGCGAATCTACAGCCGCCCTGGGCTGCCTCGTGAAGGACTACTTTCCCGAGCCCGTG ACCGTGTCCTGGAACTCTGGCGCTCTGACAAGCGGCGTGCACACCTTTCCAGCCGTGCTCCAGAGCAGCGGCCTGT ACTCTCTGAGCAGCGTCGTGACAGTGCCCAGCAGCAGCCTGGGCACCAAGACCTACACCTGTAACGTGGACCACA AGCCCAGCAACACCAAGGTGGACAAGCGGGTGGAATCTAAGTACGGCCCTCCCTGCCCTCCTTGCCCAGCCCCTG AAGCTGCCGGCGGACCCTCCGTGTTCCTGTTCCCCCCAAAGCCCAAGGACACCCTGATGATCAGCCGGACCCCCGA AGTGACCTGCGTGGTGGTGGATGTGTCCCAGGAAGATCCCGAGGTGCAGTTCAATTGGTACGTGGACGGCGTGGA AGTGCACAACGCCAAGACCAAGCCCAGAGAGGAACAGTTCAACAGCACCTACCGGGTGGTGTCCGTGCTGACCGT GCTGCACCAGGACTGGCTGAACGGCAAAGAGTACAAGTGCAAGGTGTCCAACAAGGGCCTGCCCAGCTCCATCGA GAAAACCATCAGCAAGGCCAAGGGCCAGCCCCGCGAGCCTCAAGTGTATACCCTGCCCCCTTGCCAGGAAGAGAT GACCAAGAACCAGGTGTCCCTGTGGTGTCTCGTGAAAGGCTTCTACCCCAGCGACATTGCCGTGGAATGGGAGAG CAACGGCCAGCCCGAGAACAACTACAAGACCACCCCCCCTGTGCTGGACAGCGACGGCTCATTCTTCCTGTACTCC AAGCTGACCGTGGACAAGAGCCGGTGGCAGGAAGGCAACGTGTTCAGCTGCTCCGTGATGCACGAGGCCCTGCAC AACCACTACACCCAGAAGTCCCTGTCTCTGTCCCTGGGC |
| | 4 | 256 | GACATCGTGATGACCCAGAGCCAGAAATTCATGAGCGCCAGCGTGGGCGACAGAGTGTCCATCACATGTAAAGCC AGCCAGAACGTGGGCACAGCCGTGGCTTGGTATCAGCAGCAGCCTGGCCACTCTCCTAAGCAGCTGATCTACAGC GCCAGCAACAGATACACCGGCGTGCCCGATAGATTCACAGGATCTGGCGCCGGAACCGACTTCACCCTGACCATC AGCAACATCCAGAGCGAGGACCTGGCCGACTACTTCTGCCAGCAGTACAGCACATACCCCTTCACCTTTGGCAGCG GCACCAAGCTGGAAATCAAGCGTACGGTGGCCGCTCCCAGCGTGTTCATCTTCCCACCTAGCGACGAGCAGCTGA AGTCCGGCACAGCCTCTGTCGTGTGCCTGCTGAACAACTTCTACCCCCGCGAGGCCAAAGTGCAGTGGAAGGTGG ACAACGCCCTGCAGAGCGGCAACAGCCAGGAAAGCGTGACCGAGCAGGACAGCAAGGACTCCACCTACAGCCTG AGCAGCACCCTGACACTGAGCAAGGCCGACTACGAGAAGCACAAGGTGTACGCCTGCGAAGTGACCCACCAGGG CCTGTCTAGCCCCGTGACCAAGAGCTTCAACCGGGGCGAGTGT |

TABLE 6-continued

| Trispecific binding protein polynucleotide sequences | | | |
|---|---|---|---|
| Molecule | Polypeptide Number (acc. to formula) | SEQ ID NO | Sequence |
| CD38hyb6284/ CD28sup x CD3mid_ENLQ DKTHT IgG4 FALA BP #7 | 1 | 257 | GACATCGTGATGACCCAGACCCCCCTGAGCCTGAGCGTGACACCTGGACAGCCTGCCAGCATCAGCTGCAAGAGC AGCCAGAGCCTGGTGCACGAGAACCTGCAGACCTACCTGAGCTGGTATCTGCAGAAGCCCGGCCAGAGCCCCCAG TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGACAAAACCCATACCGACATCCAGATGACCCAGAGCCCCA GCAGCCTGTCTGCCAGCGTGGGCGACAGAGTGACCATCACCTGTCAGGCCAGCCAGAACATCTACGTGTGGCTGA ACTGGTATCAGCAGAAGCCCGGCAAGGCCCCCAAGCTGCTGATCTACAAGGCCAGCAACCTGCACACCGGCGTGC CCAGCAGATTTTCTGGCAGCGGCTCCGGCACCGACTTCACCCTGACAATCAGCTCCCTGCAGCCCGAGGACATTGC CACCTACTACTGCCAGCAGGGCCAGACCTACCCCTACACCTTTGGCCAGGGCACCAAGCTGGAAATCAAGGATAA GACCCACACCCGTACGGTGGCCGCTCCCAGCGTGTTCATCTTCCCACCTAGCGACGAGCAGCTGAAGTCCGGCACA GCCTCTGTCGTGTGCCTGCTGAACAACTTCTACCCCCGCGAGGCCAAAGTGCAGTGGAAGGTGGACAACGCCCTGC AGAGCGGCAACAGCCAGGAAAGCGTGACCGAGCAGGACAGCAAGGACTCCACCTACAGCCTGAGCAGCACCCTG ACACTGAGCAAGGCCGACTACGAGAAGCACAAGGTGTACGCCTGCGAAGTGACCCACCAGGGCCTGTCTAGCCCC GTGACCAAGAGCTTCAACCGGGGCGAGTGT |
| | 2 | 258 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 259 | CAGGTTCAGCTGCTGCAGTCTGGCGCCGAACTTGTCAGACCTGGCGTGTCCGTGAAGATCAGCTGTACAGGCAGCG GCTACAGCTTCACCAACTACGCCGTGCACTGGGTCAAGCAGAGCCACGTGAAGTCCCTGGAATGGATCGGCGTGA TCAGCCCCTACTACGGCGACACCACCTACAACCAGAAGTTCACCGGCAAGGCCACCATGACCGTGGACAAGTCTA GCAGCACCGCCTACATGGAACTGGCCAGACTGACCAGCGAGGACAGCGCCATCTACTTTTGCGCCAGAAGATTCG AGGGCTTCTACTACAGCATGGACTACTGGGGCCAGGGCACCAGCGTGACAGTTTCTTCTGCGTCGACCAAGGGCCC ATCGGTGTTCCCTCTGGCCCCTTGCAGCAGAAGCACCAGCGAATCTACAGCCGCCCTGGGCTGCCTCGTGAAGGAC TACTTTCCCGAGCCCGTGACCGTGTCCTGGAACTCTGGCGCTCTGACAAGCGGCGTGCACACCTTTCCAGCCGTGC |

TABLE 6-continued

Trispecific binding protein polynucleotide sequences

| Molecule | Polypeptide Number (acc. to formula) | SEQ ID NO | Sequence |
|---|---|---|---|
| | | | TCCAGAGCAGCGGCCTGTACTCTCTGAGCAGCGTCGTGACAGTGCCCAGCAGCAGCCTGGGCACCAAGACCTACA CCTGTAACGTGGACCACAAGCCCAGCAACACCAAGGTGGACAAGCGGGTGGAATCTAAGTACGGCCCTCCCTGCC CTCCTTGCCCAGCCCCTGAAGCTGCCGGCGGACCCTCCGTGTTCCTGTTCCCCCCAAAGCCCAAGGACACCCTGAT GATCAGCCGGACCCCCGAAGTGACCTGCGTGGTGGTGGATGTGTCCCAGGAAGATCCCGAGGTGCAGTTCAATTG GTACGTGGACGGCGTGGAAGTGCACAACGCCAAGACCAAGCCCAGAGAGGAACAGTTCAACAGCACCTACCGGG TGGTGTCCGTGCTGACCGTGCTGCACCAGGACTGGCTGAACGGCAAAGAGTACAAGTGCAAGGTGTCCAACAAGG GCCTGCCCAGCTCCATCGAGAAAACCATCAGCAAGGCCAAGGGCCAGCCCCGCGAGCCTCAAGTGTATACCCTGC CCCCTTGCCAGGAAGAGATGACCAAGAACCAGGTGTCCCTGTGGTGTCTCGTGAAAGGCTTCTACCCCAGCGACAT TGCCGTGGAATGGGAGAGCAACGGCCAGCCCGAGAACAACTACAAGACCACCCCCCCTGTGCTGGACAGCGACGG CTCATTCTTCCTGTACTCCAAGCTGACCGTGGACAAGAGCCGGTGGCAGGAAGGCAACGTGTTCAGCTGCTCCGTG ATGCACGAGGCCCTGCACAACCACTACACCCAGAAGTCCCTGTCTCTGTCCCTGGGC |
| | 4 | 260 | GACGTGGTCATGATCCAGACACCTCTGAGCCTGCCTGTGTCTCTGGGAGATCAGGCCAGCATCAGCTGCAGACCTA GCCAGTCTCTGGTGCACAGCAACGGCAACACCTACCTGAACTGGTATCTGCAGAGGCCCGGACAGAGCCCCAAGC TGCTGATCTACAAGGTGTCCAAGCGGTTCAGCGGCGTGCCCGATAGATTTTCTGGCAGCGGCTCTGGCACCGACTT CACCCTGAAGATTAGCAGAGTGGAAGCCGAGGACCTGGGCGTGTACCTGTGTTCTCAGAGCACACACGTGCCCCT GACCTTTGGCAGCGGAACCCAGCTGGAAATCAAGCGTACGGTGGCCGCTCCCAGCGTGTTCATCTTCCCACCTAGC GACGAGCAGCTGAAGTCCGGCACAGCCTCTGTCGTGTGCCTGCTGAACAACTTCTACCCCCGCGAGGCCAAAGTGC AGTGGAAGGTGGACAACGCCCTGCAGAGCGGCAACAGCCAGGAAAGCGTGACCGAGCAGGACAGCAAGGACTCC ACCTACAGCCTGAGCAGCACCCTGACACTGAGCAAGGCCGACTACGAGAAGCACAAGGTGTACGCCTGCGAAGTG ACCCACCAGGGCCTGTCTAGCCCCGTGACCAAGAGCTTCAACCGGGGCGAGTGT |
| CD38hhy1195/ CD28sup x CD3mid_ENLQ DKTHT_IgG4 FALA BP #8 | 1 | 261 | GACATCGTGATGACCCAGACCCCCCTGAGCCTGAGCGTGACACCTGGACAGCCTGCCAGCATCAGCTGCAAGAGC AGCCAGAGCCTGGTGCACGAGAACCTGCAGACCTACCTGAGCTGGTATCTGCAGAAGCCCGGCCAGAGCCCCCAG TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGACAAAACCCATACCGACATCCAGATGACCCAGAGCCCCA GCAGCCTGTCTGCCAGCGTGGGCGACAGAGTGACCATCACCTGTCAGGCCAGCCAGAACATCTACGTGTGGCTGA ACTGGTATCAGCAGAAGCCCGGCAAGGCCCCCAAGCTGCTGATCTACAAGGCCAGCAACCTGCACACCGGCGTGC CCAGCAGATTTTCTGGCAGCGGCTCCGGCACCGACTTCACCCTGACAATCAGCTCCCTGCAGCCCGAGGACATTGC CACCTACTACTGCCAGCAGGGCCAGACCTACCCCTACACCTTTGGCCAGGGCACCAAGCTGGAAATCAAGGATAA GACCCACACCCGTACGGTGGCCGCTCCCAGCGTGTTCATCTTCCCACCTAGCGACGAGCAGCTGAAGTCCGGCACA GCCTCTGTCGTGTGCCTGCTGAACAACTTCTACCCCCGCGAGGCCAAAGTGCAGTGGAAGGTGGACAACGCCCTGC AGAGCGGCAACAGCCAGGAAAGCGTGACCGAGCAGGACAGCAAGGACTCCACCTACAGCCTGAGCAGCACCCTG ACACTGAGCAAGGCCGACTACGAGAAGCACAAGGTGTACGCCTGCGAAGTGACCCACCAGGGCCTGTCTAGCCCC GTGACCAAGAGCTTCAACCGGGGCGAGTGT |
| | 2 | 262 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC |

TABLE 6-continued

| Trispecific binding protein polynucleotide sequences | | | |
|---|---|---|---|
| Molecule | Polypeptide Number (acc. to formula) | SEQ ID NO | Sequence |
| | | | GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| | 3 | 263 | CAGGTGCAGCTGGTGGAATCTGGCGGCGGAGTGGTGCAGCCTGGCAGAAGCCTGAGACTGAGCTGTGCCGCCAGC<br>GGCTTCACCTTCAGCAGCTACGGCATGTACTGGGTGCGCCAGGCCCCTGGCAAAGGCCTGGAATGGGTGGCCGTG<br>ATTTGGTACGACGGCAGCAACAAGTACTACGCCGACAGCGTGAAGGGCCGGTTCACCATCTCCCGGGACAACAGC<br>AAGAACACCCTGTACCTGCAGATGAACAGCCTGCGGGCCGAGGACACAGCCGTGTATCACTGCGCCAGAGATCCC<br>GGCCTGCGGTACTTTGACGGCGGCATGGATGTGTGGGGCCAGGGCACAACCGTGACCGTGTCATCTGCGTCGACC<br>AAGGGCCCATCGGTGTTCCCTCTGGCCCCTTGCAGCAGAAGCACCAGCGAATCTACAGCCGCCCTGGGCTGCCTCG<br>TGAAGGACTACTTTCCCGAGCCCGTGACCGTGTCCTGGAACTCTGGCGCTCTGACAAGCGGCGTGCACACCTTTCC<br>AGCCGTGCTCCAGAGCAGCGGCCTGTACTCTCTGAGCAGCGTCGTGACAGTGCCCAGCAGCAGCCTGGGCACCAA<br>GACCTACACCTGTAACGTGGACCACAAGCCCAGCAACACCAAGGTGGACAAGCGGGTGGAATCTAAGTACGGCCC<br>TCCCTGCCCTCCTTGCCCAGCCCCTGAAGCTGCCGGCGGACCCTCCGTGTTCCTGTTCCCCCCAAAGCCCAAGGAC<br>ACCCTGATGATCAGCCGGACCCCCGAAGTGACCTGCGTGGTGGTGGATGTGTCCCAGGAAGATCCCGAGGTGCAG<br>TTCAATTGGTACGTGGACGGCGTGGAAGTGCACAACGCCAAGACCAAGCCCAGAGAGGAACAGTTCAACAGCACC<br>TACCGGGTGGTGTCCGTGCTGACCGTGCTGCACCAGGACTGGCTGAACGGCAAAGAGTACAAGTGCAAGGTGTCC<br>AACAAGGGCCTGCCCAGCTCCATCGAGAAAACCATCAGCAAGGCCAAGGGCCAGCCCCGCGAGCCTCAAGTGTAT<br>ACCCTGCCCCCTTGCCAGGAAGAGATGACCAAGAACCAGGTGTCCCTGTGGTGTCTCGTGAAAGGCTTCTACCCCA<br>GCGACATTGCCGTGGAATGGGAGAGCAACGGCCAGCCCGAGAACAACTACAAGACCACCCCCCCTGTGCTGGACA<br>GCGACGGCTCATTCTTCCTGTACTCCAAGCTGACCGTGGACAAGAGCCGGTGGCAGGAAGGCAACGTGTTCAGCT<br>GCTCCGTGATGCACGAGGCCCTGCACAACCACTACACCCAGAAGTCCCTGTCTCTGTCCCTGGGC |
| | 4 | 264 | GACATCCAGCTGACCCAGAGCCCCAGCTTTCTGAGCGCCAGCGTGGGCGACAGAGTGACCATCACCTGTAGAGCC<br>AGCCAGGGCATCAGCAGCTACCTGGCCTGGTATCAGCAGAAGCCCGGCAAGGCCCCCAAACTGCTGATCTTTGCC<br>GCCAGCACACTGCACAGCGGCGTGCCCAGCAGATTTTCTGGCAGCGGCTCCGGCACCGAGTTCACCCTGACAATCA<br>GCAGCCTGCAGCCCGAGGACTTCGCCACCTACTACTGCCAGCAGCTGAACAGCTTCCCCTACACCTTCGGCCAGGG<br>CACCAAGCTGGAAATCAAGCGTACGGTGGCCGCTCCCAGCGTGTTCATCTTCCCACCTAGCGACGAGCAGCTGAA<br>GTCCGGCACAGCCTCTGTCGTGTGCCTGCTGAACAACTTCTACCCCCGCGAGGCCAAAGTGCAGTGGAAGGTGGAC<br>AACGCCCTGCAGAGCGGCAACAGCCAGGAAAGCGTGACCGAGCAGGACAGCAAGGACTCCACCTACAGCCTGAG<br>CAGCACCCTGACACTGAGCAAGGCCGACTACGAGAAGCACAAGGTGTACGCCTGCGAAGTGACCCACCAGGGCCT<br>GTCTAGCCCCGTGACCAAGAGCTTCAACCGGGGCGAGTGT |
| CD38hhy1370/ CD28sup x | 1 | 265 | GACATCGTGATGACCCAGACCCCCCTGAGCCTGAGCGTGACACCTGGACAGCCTGCCAGCATCAGCTGCAAGAGC<br>AGCCAGAGCCTGGTGCACGAGAACCTGCAGACCTACCTGAGCTGGTATCTGCAGAAGCCCGGCCAGAGCCCCCAG |

TABLE 6-continued

Trispecific binding protein polynucleotide sequences

| Molecule | Polypeptide Number (acc. to formula) | SEQ ID NO | Sequence |
|---|---|---|---|
| CD3mid_ENLQ DKTHT IgG4 FALA BP #9 | | | TCCCTGATCTACAAGGTGTCCAACAGATTCAGCGGCGTGCCCGACAGATTCTCCGGCAGCGGCTCTGGCACCGACT TCACCCTGAAGATCAGCCGGGTGGAAGCCGAGGACGTGGGCGTGTACTATTGTGGCCAGGGCACCCAGTACCCCT TCACCTTTGGCAGCGGCACCAAGGTGGAAATCAAGGACAAAACCCATACCGACATCCAGATGACCCAGAGCCCCA GCAGCCTGTCTGCCAGCGTGGGCGACAGAGTGACCATCACCTGTCAGGCCAGCCAGAACATCTACGTGTGGCTGA ACTGGTATCAGCAGAAGCCCGGCAAGGCCCCCAAGCTGCTGATCTACAAGGCCAGCAACCTGCACACCGGCGTGC CCAGCAGATTTTCTGGCAGCGGCTCCGGCACCGACTTCACCCTGACAATCAGCTCCCTGCAGCCCGAGGACATTGC CACCTACTACTGCCAGCAGGGCCAGACCTACCCCTACACCTTTGGCCAGGGCACCAAGCTGGAAATCAAGGATAA GACCCACACCCGTACGGTGGCCGCTCCCAGCGTGTTCATCTTCCCACCTAGCGACGAGCAGCTGAAGTCCGGCACA GCCTCTGTCGTGTGCCTGCTGAACAACTTCTACCCCCGCGAGGCCAAAGTGCAGTGGAAGGTGGACAACGCCCTGC AGAGCGGCAACAGCCAGGAAAGCGTGACCGAGCAGGACAGCAAGGACTCCACCTACAGCCTGAGCAGCACCCTG ACACTGAGCAAGGCCGACTACGAGAAGCACAAGGTGTACGCCTGCGAAGTGACCCACCAGGGCCTGTCTAGCCCC GTGACCAAGAGCTTCAACCGGGGCGAGTGT |
| | 2 | 266 | CAGGTGCAGCTGGTGCAGTCTGGCGCCGAGGTCGTGAAACCTGGCGCCTCTGTGAAGGTGTCCTGCAAGGCCAGC GGCTACACCTTTACCAGCTACTACATCCACTGGGTGCGCCAGGCCCCTGGACAGGGACTGGAATGGATCGGCAGC ATCTACCCCGGCAACGTGAACACCAACTACGCCCAGAAGTTCCAGGGCAGAGCCACCCTGACCGTGGACACCAGC ATCAGCACCGCCTACATGGAACTGAGCCGGCTGAGAAGCGACGACACCGCCGTGTACTACTGCACCCGGTCCCAC TACGGCCTGGATTGGAACTTCGACGTGTGGGGCAAGGGCACCACCGTGACAGTGTCTAGCGACAAAACCCATACC CAGGTGCAGCTGGTGGAATCTGGCGGCGGAGTGGTGCAGCCTGGCAGAAGCCTGAGACTGAGCTGTGCCGCCAGC GGCTTCACCTTCACCAAGGCCTGGATGCACTGGGTGCGCCAGGCCCCTGGAAAGCAGCTGGAATGGGTGGCCCAG ATCAAGGACAAGAGCAACAGCTACGCCACCTACTACGCCGACAGCGTGAAGGGCCGGTTCACCATCAGCCGGGAC GACAGCAAGAACACCCTGTACCTGCAGATGAACAGCCTGCGGGCCGAGGACACCGCCGTGTACTACTGTCGGGGC GTGTACTATGCCCTGAGCCCCTTCGATTACTGGGGCCAGGGAACCCTCGTGACCGTGTCTAGTGATAAGACCCACA CCGCCAGCACAAAGGGCCCATCGGTGTTCCCTCTGGCCCCTTGCAGCAGAAGCACCAGCGAATCTACAGCCGCCCT GGGCTGCCTCGTGAAGGACTACTTTCCCGAGCCCGTGACCGTGTCCTGGAACTCTGGCGCTCTGACAAGCGGCGTG CACACCTTTCCAGCCGTGCTCCAGAGCAGCGGCCTGTACTCTCTGAGCAGCGTCGTGACAGTGCCCAGCAGCAGCC TGGGCACCAAGACCTACACCTGTAACGTGGACCACAAGCCCAGCAACACCAAGGTGGACAAGCGGGTGGAATCTA AGTACGGCCCTCCCTGCCCTCCTTGCCCAGCCCCTGAAGCTGCCGGCGGACCCTCCGTGTTCCTGTTCCCCCCAAAG CCCAAGGACACCCTGATGATCAGCCGGACCCCCGAAGTGACCTGCGTGGTGGTGGATGTGTCCCAGGAAGATCCC GAGGTGCAGTTCAATTGGTACGTGGACGGCGTGGAAGTGCACAACGCCAAGACCAAGCCCAGAGAGGAACAGTTC AACAGCACCTACCGGGTGGTGTCCGTGCTGACCGTGCTGCACCAGGACTGGCTGAACGGCAAAGAGTACAAGTGC AAGGTGTCCAACAAGGGCCTGCCCAGCTCCATCGAGAAAACCATCAGCAAGGCCAAGGGCCAGCCCCGCGAGCCT CAAGTGTGTACCCTGCCCCCTAGCCAGGAAGAGATGACCAAGAACCAGGTGTCCCTGAGCTGTGCCGTGAAAGGC TTCTACCCCAGCGACATTGCCGTGGAATGGGAGAGCAACGGCCAGCCCGAGAACAACTACAAGACCACCCCCCCT GTGCTGGACAGCGACGGCTCATTCTTCCTGGTGTCCAAGCTGACCGTGGACAAGAGCCGGTGGCAGGAAGGCAAC GTGTTCAGCTGCTCCGTGATGCACGAGGCCCTGCACAACCACTACACCCAGAAGTCCCTGTCTCTGTCCCTGGGC |
| | 3 | 267 | CAGGTGCAGCTGGTGGAAAGCGGCGGAGGCGTGGTGCAGCCTGGCAGGTCTCTGAGACTGAGCTGTGCCGCCAGC GGCTTCACCTTCAGCAGCTACGGAATGCACTGGGTGCGCCAGGCCCCTGGCAAAGGACTGGAATGGGTGGCCGTG ATTTGGTACGACGGCAGCAACAAGTACTACGCCGACAGCGTGAAGGGCCGGTTCACCATCAGCGGCGACAACAGC AAGAACACCCTGTACCTGCAGATGAACAGCCTGCGGGCCGAGGACACCGCCGTGTACTACTGCGCCAGAATGTTC AGAGGCGCCTTCGACTACTGGGGCCAGGGCACACTCGTGACCGTGTCTAGTGCGTCGACCAAGGGCCCATCGGTG TTCCCTCTGGCCCCTTGCAGCAGAAGCACCAGCGAATCTACAGCCGCCCTGGGCTGCCTCGTGAAGGACTACTTTC CCGAGCCCGTGACCGTGTCCTGGAACTCTGGCGCTCTGACAAGCGGCGTGCACACCTTTCCAGCCGTGCTCCAGAG CAGCGGCCTGTACTCTCTGAGCAGCGTCGTGACAGTGCCCAGCAGCAGCCTGGGCACCAAGACCTACACCTGTAA CGTGGACCACAAGCCCAGCAACACCAAGGTGGACAAGCGGGTGGAATCTAAGTACGGCCCTCCCTGCCCTCCTTG |

TABLE 6-continued

Trispecific binding protein polynucleotide sequences

| Molecule | Polypeptide Number (acc. to formula) | SEQ ID NO | Sequence |
|---|---|---|---|
| | | | CCCAGCCCCTGAAGCTGCCGGCGGACCCTCCGTGTTCCTGTTCCCCCCAAAGCCCAAGGACACCCTGATGATCAGC<br>CGGACCCCCGAAGTGACCTGCGTGGTGGTGGATGTGTCCCAGGAAGATCCCGAGGTGCAGTTCAATTGGTACGTG<br>GACGGCGTGGAAGTGCACAACGCCAAGACCAAGCCCAGAGAGGAACAGTTCAACAGCACCTACCGGGTGGTGTC<br>CGTGCTGACCGTGCTGCACCAGGACTGGCTGAACGGCAAAGAGTACAAGTGCAAGGTGTCCAACAAGGGCCTGCC<br>CAGCTCCATCGAGAAAACCATCAGCAAGGCCAAGGGCCAGCCCCGCGAGCCTCAAGTGTATACCCTGCCCCCTTG<br>CCAGGAAGAGATGACCAAGAACCAGGTGTCCCTGTGGTGTCTCGTGAAAGGCTTCTACCCCAGCGACATTGCCGT<br>GGAATGGGAGAGCAACGGCCAGCCCGAGAACAACTACAAGACCACCCCCCCTGTGCTGGACAGCGACGGCTCATT<br>CTTCCTGTACTCCAAGCTGACCGTGGACAAGAGCCGGTGGCAGGAAGGCAACGTGTTCAGCTGCTCCGTGATGCAC<br>GAGGCCCTGCACAACCACTACACCCAGAAGTCCCTGTCTCTGTCCCTGGGC |
| | 4 | 268 | GCCATCCAGATGACCCAGAGCCCCAGCAGCCTGTCTGCCAGCGTGGGCGACAGAGTGACCATCACCTGTAGAGCC<br>AGCCAGGGCATCCGGAACGACCTGGGCTGGTATCAGCAGAAGCCTGGCAAGGCCCCCAAGCTGCTGATCTACGCC<br>GCTAGCTCTCTGCAGTCCGGCGTGCCCAGCAGATTTTCTGGCAGCGGCTCCGGCACCGACTTCACCCTGACAATCT<br>CTGGCCTGCAGCCCGAGGACAGCGCCACCTACTACTGTCTGCAAGACTACATCTACTACCCCACCTTCGGCCAGGG<br>CACCAAGGTGGAAATCAAGCGTACGGTGGCCGCTCCCAGCGTGTTCATCTTCCCACCTAGCGACGAGCAGCTGAA<br>GTCCGGCACAGCCTCTGTCGTGTGCCTGCTGAACAACTTCTACCCCCGCGAGGCCAAAGTGCAGTGGAAGGTGGAC<br>AACGCCCTGCAGAGCGGCAACAGCCAGGAAAGCGTGACCGAGCAGGACAGCAAGGACTCCACCTACAGCCTGAG<br>CAGCACCCTGACACTGAGCAAGGCCGACTACGAGAAGCACAAGGTGTACGCCTGCGAAGTGACCCACCAGGGCCT<br>GTCTAGCCCCGTGACCAAGAGCTTCAACCGGGGCGAGTGT |
| CD38hu5739/ CD28sup x CD3mid_ENLQ DKTHT IgG4 FALA | 1 | 269 | GACATCGTGATGACCCAGACCCCCCTGAGCCTGAGCGTGACACCTGGACAGCCTGCCAGCATCAGCTGCAAGAGC<br>AGCCAGAGCCTGGTGCACGAGAACCTGCAGACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT<br>TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |
| | 2 | 270 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT |

TABLE 6-continued

| Trispecific binding protein polynucleotide sequences | | | |
|---|---|---|---|
| Molecule | Polypeptide Number (acc. to formula) | SEQ ID NO | Sequence |
| | | | GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| | 3 | 271 | CAGGTTCAGCTGGTTCAGTCTGGCGCCGAAGTGAAGAAACCTGGCGCCTCTGTGAAGGTGTCCTGCAAGGCCTCTG<br>GCTACGCCTTCACCACCTACCTGGTGGAATGGATCAGACAGAGGCCTGGACAGGGCCTCGAATGGATGGGCGTGA<br>TCAATCCTGGCAGCGGCAGCACCAATTACGCCCAGAAATTCCAGGGCAGAGTGACCATGACCGTGGACAGAAGCA<br>GCACCACCGCCTACATGGAACTGAGCAGACTGAGAAGCGACGACACCGCCGTGTACTACTGTGCCAGATACGCCT<br>ACGGCTATTGGGGCCAGGGAACCCTGGTTACCGTTAGCTCTGCGTCGACCAAGGGCCCATCGGTGTTCCCTCTGGC<br>CCCTTGCAGCAGAAGCACCAGCGAATCTACAGCCGCCCTGGGCTGCCTCGTGAAGGACTACTTTCCCGAGCCCGTG<br>ACCGTGTCCTGGAACTCTGGCGCTCTGACAAGCGGCGTGCACACCTTTCCAGCCGTGCTCCAGAGCAGCGGCCTGT<br>ACTCTCTGAGCAGCGTCGTGACAGTGCCCAGCAGCAGCCTGGGCACCAAGACCTACACCTGTAACGTGGACCACA<br>AGCCCAGCAACACCAAGGTGGACAAGCGGGTGGAATCTAAGTACGGCCCTCCCTGCCCTCCTTGCCCAGCCCCTG<br>AAGCTGCCGGCGGACCCTCCGTGTTCCTGTTCCCCCCAAAGCCCAAGGACACCCTGATGATCAGCCGGACCCCCGA<br>AGTGACCTGCGTGGTGGTGGATGTGTCCCAGGAAGATCCCGAGGTGCAGTTCAATTGGTACGTGGACGGCGTGGA<br>AGTGCACAACGCCAAGACCAAGCCCAGAGAGGAACAGTTCAACAGCACCTACCGGGTGGTGTCCGTGCTGACCGT<br>GCTGCACCAGGACTGGCTGAACGGCAAAGAGTACAAGTGCAAGGTGTCCAACAAGGGCCTGCCCAGCTCCATCGA<br>GAAAACCATCAGCAAGGCCAAGGGCCAGCCCCGCGAGCCTCAAGTGTATACCCTGCCCCCTTGCCAGGAAGAGAT<br>GACCAAGAACCAGGTGTCCCTGTGGTGTCTCGTGAAAGGCTTCTACCCCAGCGACATTGCCGTGGAATGGGAGAG<br>CAACGGCCAGCCCGAGAACAACTACAAGACCACCCCCCCTGTGCTGGACAGCGACGGCTCATTCTTCCTGTACTCC<br>AAGCTGACCGTGGACAAGAGCCGGTGGCAGGAAGGCAACGTGTTCAGCTGCTCCGTGATGCACGAGGCCCTGCAC<br>AACCACTACACCCAGAAGTCCCTGTCTCTGTCCCTGGGC |
| | 4 | 272 | GACATCCAGATGACACAGAGCCCTAGCAGCCTGTCTGCCAGCGTGGGAGACAGAGTGACCATCACCTGTAGAGCC<br>AGCCAGAATGTGGGAACAGCCGTGGCCTGGTATCAGCAGAAGCCTGGCAAGAGCCCCAAGCAGCTGATCTACAGC<br>GCCAGCAACAGATACACCGGCGTGCCCAGCAGATTTTCTGGCAGCGGCTCTGGCACCGACTTCACCCTGACCATAT<br>CTAGCCTGCAGCCTGAGGACCTGGCCACCTACTACTGTCAGCAGTACAGCACATACCCCTTCACCTTCGGCCAGGG<br>CACCAAGCTGGAAATCAAGCGTACGGTGGCCGCTCCCAGCGTGTTCATCTTCCCACCTAGCGACGAGCAGCTGAA<br>GTCCGGCACAGCCTCTGTCGTGTGCCTGCTGAACAACTTCTACCCCCGCGAGGCCAAAGTGCAGTGGAAGGTGGAC<br>AACGCCCTGCAGAGCGGCAACAGCCAGGAAAGCGTGACCGAGCAGGACAGCAAGGACTCCACCTACAGCCTGAG<br>CAGCACCCTGACACTGAGCAAGGCCGACTACGAGAAGCACAAGGTGTACGCCTGCGAAGTGACCCACCAGGGCCT<br>GTCTAGCCCCGTGACCAAGAGCTTCAACCGGGGCGAGTGT |
| CD38hu6284/ CD28sup x CD3mid_ENLQ DKTHT IgG4 | 1 | 273 | GACATCGTGATGACCCAGACCCCCCTGAGCCTGAGCGTGACACCTGGACAGCCTGCCAGCATCAGCTGCAAGAGC<br>AGCCAGAGCCTGGTGCACGAGAACCTGCAGACCTACCTGAGCTGGTATCTGCAGAAGCCCGGCCAGAGCCCCCAG<br>TCCCTGATCTACAAGGTGTCCAACAGATTCAGCGGCGTGCCCGACAGATTCTCCGGCAGCGGCTCTGGCACCGACT<br>TCACCCTGAAGATCAGCCGGGTGGAAGCCGAGGACGTGGGCGTGTACTATTGTGGCCAGGGCACCCAGTACCCCT |

TABLE 6-continued

| Trispecific binding protein polynucleotide sequences | | | |
|---|---|---|---|
| Molecule | Polypeptide Number (acc. to formula) | SEQ ID NO | Sequence |
| FALA | | | TCACCTTTGGCAGCGGCACCAAGGTGGAAATCAAGGACAAAACCCATACCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGA<br>ACTGGTATCAGCAGAAGCCCGGCAAGGCCCCCAAGCTGCTGATCTACAAGGCCAGCAACCTGCACACCGGCGTGC<br>CCAGCAGATTTTCTGGCAGCGGCTCCGGCACCGACTTCACCCTGACAATCAGCTCCCTGCAGCCCGAGGACATTGC<br>CACCTACTACTGCCAGCAGGGCCAGACCTACCCCTACACCTTTGGCCAGGGCACCAAGCTGGAAATCAAGGATAA<br>GACCCACACCCGTACGGTGGCCGCTCCCAGCGTGTTCATCTTCCCACCTAGCGACGAGCAGCTGAAGTCCGGCACA<br>GCCTCTGTCGTGTGCCTGCTGAACAACTTCTACCCCCGCGAGGCCAAAGTGCAGTGGAAGGTGGACAACGCCCTGC<br>AGAGCGGCAACAGCCAGGAAAGCGTGACCGAGCAGGACAGCAAGGACTCCACCTACAGCCTGAGCAGCACCCTG<br>ACACTGAGCAAGGCCGACTACGAGAAGCACAAGGTGTACGCCTGCGAAGTGACCCACCAGGGCCTGTCTAGCCCC<br>GTGACCAAGAGCTTCAACCGGGGCGAGTGT |
| | 2 | 274 | CAGGTGCAGCTGGTGCAGTCTGGCGCCGAGGTCGTGAAACCTGGCGCCTCTGTGAAGGTGTCCTGCAAGGCCAGC<br>GGCTACACCTTTACCAGCTACTACATCCACTGGGTGCGCCAGGCCCCTGGACAGGGACTGGAATGGATCGGCAGC<br>ATCTACCCCGGCAACGTGAACACCAACTACGCCCAGAAGTTCCAGGGCAGAGCCACCCTGACCGTGGACACCAGC<br>ATCAGCACCGCCTACATGGAACTGAGCCGGCTGAGAAGCGACGACACCGCCGTGTACTACTGCACCCGGTCCCAC<br>TACGGCCTGGATTGGAACTTCGACGTGTGGGGCAAGGGCACCACCGTGACAGTGTCTAGCGACAAAACCCATACC<br>CAGGTGCAGCTGGTGGAATCTGGCGGCGGAGTGGTGCAGCCTGGCAGAAGCCTGAGACTGAGCTGTGCCGCCAGC<br>GGCTTCACCTTCACCAAGGCCTGGATGCACTGGGTGCGCCAGGCCCCTGGAAAGCAGCTGGAATGGGTGGCCCAG<br>ATCAAGGACAAGAGCAACAGCTACGCCACCTACTACGCCGACAGCGTGAAGGGCCGGTTCACCATCAGCCGGGAC<br>GACAGCAAGAACACCCTGTACCTGCAGATGAACAGCCTGCGGGCCGAGGACACCGCCGTGTACTACTGTCGGGGC<br>GTGTACTATGCCCTGAGCCCCTTCGATTACTGGGGCCAGGGAACCCTCGTGACCGTGTCTAGTGATAAGACCCACA<br>CCGCCAGCACAAAGGGCCCATCGGTGTTCCCTCTGGCCCCTTGCAGCAGAAGCACCAGCGAATCTACAGCCGCCCT<br>GGGCTGCCTCGTGAAGGACTACTTTCCCGAGCCCGTGACCGTGTCCTGGAACTCTGGCGCTCTGACAAGCGGCGTG<br>CACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTA<br>AGTACGGCCCTCCCTGCCCTCCTTGCCCAGCCCCTGAAGCTGCCGGCGGACCCTCCGTGTTCCTGTTCCCCCCAAAG<br>CCCAAGGACACCCTGATGATCAGCCGGACCCCCGAAGTGACCTGCGTGGTGGTGGATGTGTCCCAGGAAGATCCC<br>GAGGTGCAGTTCAATTGGTACGTGGACGGCGTGGAAGTGCACAACGCCAAGACCAAGCCCAGAGAGGAACAGTTC<br>AACAGCACCTACCGGGTGGTGTCCGTGCTGACCGTGCTGCACCAGGACTGGCTGAACGGCAAAGAGTACAAGTGC<br>AAGGTGTCCAACAAGGGCCTGCCCAGCTCCATCGAGAAAACCATCAGCAAGGCCAAGGGCCAGCCCCGCGAGCCT<br>CAAGTGTGTACCCTGCCCCCTAGCCAGGAAGAGATGACCAAGAACCAGGTGTCCCTGAGCTGTGCCGTGAAAGGC<br>TTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGGTGTCCAAGCTGACCGTGGACAAGAGCCGGTGGCAGGAAGGCAAC<br>GTGTTCAGCTGCTCCGTGATGCACGAGGCCCTGCACAACCACTACACCCAGAAGTCCCTGTCTCTGTCCCTGGGC |
| | 3 | 275 | CAGGTTCAGCTGGTTCAGTCTGGCGCCGAAGTGAAGAAACCTGGCGCCTCTGTGAAGGTGTCCTGCAAGGCCAGC<br>GGCTACAGCTTCACCAATTACGCCGTGCACTGGGTCCGACAGGCTCCAGGACAAGGACTGGAATGGATGGGCGTG<br>ATCAGCCCCTACTACGGCGATACCACATACGCCCAGAAATTCCAGGGCAGAGTGACCATGACCGTGGACAAGAGC<br>AGCAGCACCGCCTACATGGAACTGAGCAGACTGAGAAGCGACGACACCGCCGTGTACTACTGCGCCAGAAGATTC<br>GAGGGCTTCTACTACAGCATGGACTACTGGGGCCAGGGCACCCTGGTTACAGTCTCTTCTGCGTCGACCAAGGGCC<br>CATCGGTGTTCCCTCTGGCCCCTTGCAGCAGAAGCACCAGCGAATCTACAGCCGCCCTGGGCTGCCTCGTGAAGGA<br>CTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTAC<br>ACCTGTAACGTGGACCACAAGCCCAGCAACACCAAGGTGGACAAGCGGGTGGAATCTAAGTACGGCCCTCCCTGC<br>CCTCCTTGCCCAGCCCCTGAAGCTGCCGGCGGACCCTCCGTGTTCCTGTTCCCCCCAAAGCCCAAGGACACCCTGA<br>TGATCAGCCGGACCCCCGAAGTGACCTGCGTGGTGGTGGATGTGTCCCAGGAAGATCCCGAGGTGCAGTTCAATT |

TABLE 6-continued

| Trispecific binding protein polynucleotide sequences | | | |
| --- | --- | --- | --- |
| Molecule | Polypeptide Number (acc. to formula) | SEQ ID NO | Sequence |
| | | | GGTACGTGGACGGCGTGGAAGTGCACAACGCCAAGACCAAGCCCAGAGAGGAACAGTTCAACAGCACCTACCGG<br>GTGGTGTCCGTGCTGACCGTGCTGCACCAGGACTGGCTGAACGGCAAAGAGTACAAGTGCAAGGTGTCCAACAAG<br>GGCCTGCCCAGCTCCATCGAGAAAACCATCAGCAAGGCCAAGGGCCAGCCCCGCGAGCCTCAAGTGTATACCCTG<br>CCCCCTTGCCAGGAAGAGATGACCAAGAACCAGGTGTCCCTGTGGTGTCTCGTGAAAGGCTTCTACCCCAGCGACA<br>TTGCCGTGGAATGGGAGAGCAACGGCCAGCCCGAGAACAACTACAAGACCACCCCCCCTGTGCTGGACAGCGACG<br>GCTCATTCTTCCTGTACTCCAAGCTGACCGTGGACAAGAGCCGGTGGCAGGAAGGCAACGTGTTCAGCTGCTCCGT<br>GATGCACGAGGCCCTGCACAACCACTACACCCAGAAGTCCCTGTCTCTGTCCCTGGGC |
| | 4 | 276 | GACGTGGTCATGACACAGAGCCCTCTGAGCCTGCCTGTGACACTGGGACAGCCTGCCAGCATCAGCTGTAGACCTA<br>GCCAGAGCCTGGTGCACAGCAACGGCAACACCTACCTGAACTGGTATCAGCAGAGGCCCGGACAGAGCCCCAAGC<br>TGCTGATCTACAAGGTGTCCAAGCGGTTCAGCGGCGTGCCCGATAGATTTTCTGGCAGCGGCTCTGGCACCGACTT<br>CACCCTGAAGATTAGCAGAGTGGAAGCCGAGGACGTGGGCGTGTACTACTGTAGCCAGTCTACCCACGTGCCACT<br>GACCTTTGGCGGCGGAACAAAGGTGGAAATCAAGCGTACGGTGGCCGCTCCCAGCGTGTTCATCTTCCCACCTAGC<br>GACGAGCAGCTGAAGTCCGGCACAGCCTCTGTCGTGTGCCTGCTGAACAACTTCTACCCCCGCGAGGCCAAAGTGC<br>AGTGGAAGGTGGACAACGCCCTGCAGAGCGGCAACAGCCAGGAAAGCGTGACCGAGCAGGACAGCAAGGACTCC<br>ACCTACAGCCTGAGCAGCACCCTGACACTGAGCAAGGCCGACTACGAGAAGCACAAGGTGTACGCCTGCGAAGTG<br>ACCCACCAGGGCCTGTCTAGCCCCGTGACCAAGAGCTTCAACCGGGGCGAGTGT |

III. Trispecific and/or Trivalent Binding Proteins for Treating and/or Preventing HIV/AIDS Certain aspects of the present disclosure relate to trispecific and/or trivalent binding proteins. Any of the CDRs or variable domains of any of the antigen binding proteins described herein may find use in a trispecific binding protein of the present disclosure. Trispecific binding proteins of various formats are contemplated. In some embodiments, the binding protein of the disclosure is a trispecific and/or trivalent binding protein comprising four polypeptide chains that form three antigen binding sites that specifically bind one or more HIV target proteins, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

and wherein the polypeptide of formula I and the polypeptide of formula II form a cross-over light chain-heavy chain pair.

In some embodiments, the first polypeptide chain and the second polypeptide chain have a cross-over orientation that forms two distinct antigen binding sites. In some embodiments, the $V_{H1}$ and $V_{L1}$ form a binding pair and form the first antigen binding site. In some embodiments, the $V_{H2}$ and $V_{L2}$ form a binding pair and form the second antigen binding site. In some embodiments, the third polypeptide and the fourth polypeptide form a third antigen binding site. In some embodiments, the $V_{H3}$ and $V_{L3}$ form a binding pair and form the third antigen binding site.

In some embodiments, the term "HIV" as used herein means Human Immunodeficiency Virus. As used herein, the term "HIV infection" generally encompasses infection of a host, particularly a human host, by the human immunodeficiency virus (HIV) family of retroviruses including, but not limited to, HIV I, HIV II, HIV III (also known as HTLV-II, LAV-1, LAV-2). HIV can be used herein to refer to any strains, forms, subtypes, clades and variations in the HIV family. Thus, treating HIV infection will encompass the treatment of a person who is a carrier of any of the HIV family of retroviruses or a person who is diagnosed with active AIDS, as well as the treatment or prophylaxis of the AIDS-related conditions in such persons.

In some embodiments, the term "AIDS" as used herein means Acquired Immunodeficiency Syndrome. AIDS is caused by HIV.

In some embodiments, the terms "CD4bs" or "CD4 binding site" refer to the binding site for CD4 (cluster of differentiation 4), which is a glycoprotein found on the surface of immune cells such as T helper cells, monocytes, macrophages, and dendritic cells.

In some embodiments, the term "glycoprotein 160" or "gp160 protein" refers to the envelope glycoprotein complex of HIV and which is a homotrimer that is cleaved into gp120 and gp41 subunits.

In some embodiments, the term "MPER" refers to the membrane-proximal external region of glycoprotein 41 (gp41), which is a subunit of the envelope protein complex of retroviruses, including HIV.

In some embodiments, the term "glycan" refers to the carbohydrate portion of a glycoconjugate, such as a glycoprotein, glycolipid, or a proteoglycan. In the disclosed binding proteins, glycan refers to the HIV-1 envelope glycoprotein gp120.

In some embodiments, e.g., as used in reference to a binding protein for treating and/or preventing HIV/AIDS, the term "T-cell engager" refers to binding proteins directed to a host's immune system, more specifically the T cells' cytotoxic activity as well as directed to a HIV target protein.

In some embodiments, the term "trimer apex" refers to apex of HIV-1 envelope glycoprotein gp120.

In some embodiments, a "neutralizing" binding protein as used herein refers to a molecule that is able to block or substantially reduce an effector function of a target antigen to which it binds. As used herein, "substantially reduce" means at least about 60%, preferably at least about 70%, more preferably at least about 75%, even more preferably at least about 80%, still more preferably at least about 85%, most preferably at least about 90% reduction of an effector function of the target antigen.

In some embodiments, e.g., as used in reference to a binding protein for treating and/or preventing HIV/AIDS, the terms "treatment" or "treat" as used herein refer to both therapeutic treatment and prophylactic or preventative measures. Those in need of treatment include those having the disorder as well as those prone to have a disorder or those in which the disorder is to be prevented. In particular embodiments, binding proteins can be used to treat humans infected with HIV, or humans susceptible to HIV infection, or ameliorate HIV infection in a human subject infected with HIV. The binding proteins can also be used to prevent HIV in a human patient.

It should be understood as that treating humans infected with HIV include those subjects who are at any one of the several stages of HIV infection progression, which, for example, include acute primary infection syndrome (which can be asymptomatic or associated with an influenza-like illness with fevers, malaise, diarrhea and neurologic symptoms such as headache), asymptomatic infection (which is the long latent period with a gradual decline in the number of circulating CD4+ T cells), and AIDS (which is defined by more serious AIDS-defining illnesses and/or a decline in the circulating CD4 cell count to below a level that is compatible with effective immune function). In addition, treating or preventing HIV infection will also encompass treating suspected infection by HIV after suspected past exposure to HIV by e.g., contact with HIV-contaminated blood, blood transfusion, exchange of body fluids, "unsafe" sex with an infected person, accidental needle stick, receiving a tattoo or acupuncture with contaminated instruments, or transmission of the virus from a mother to a baby during pregnancy, delivery or shortly thereafter.

In some embodiments, one or more of the antigen binding sites binds an HIV target protein. In some embodiments, $V_{H3}$ and $V_{L3}$ form a third antigen binding site that binds an HIV target protein. In some embodiments, $V_{H1}$ and $V_{L1}$ form a first antigen binding site that binds a T cell target protein, $V_{H2}$ and $V_{L2}$ form a second antigen binding site that binds a T cell target protein, and $V_{H3}$ and $V_{L3}$ form a third antigen binding site that binds an HIV target protein. In some embodiments, $V_{H1}$ and $V_{L1}$ form a first antigen binding site that binds a T cell target protein, $V_{H2}$ and $V_{L2}$ form a second antigen binding site that binds a CD3 polypeptide, and $V_{H3}$ and $V_{L3}$ form a third antigen binding site that binds an HIV target protein. In some embodiments, $V_{H1}$ and $V_{L1}$ form a first antigen binding site that binds a CD28 polypeptide, $V_{H2}$ and $V_{L2}$ form a second antigen binding site that binds a CD3 polypeptide, and $V_{H3}$ and $V_{L3}$ form a third antigen binding site that binds an HIV target protein.

In some embodiments, the binding proteins specifically bind to one or more HIV target proteins (e.g., as described infra) and one or more target proteins on a T-cell including T cell receptor complex. These T-cell engager binding proteins are capable of recruiting T cells transiently to target cells and, at the same time, activating the cytolytic activity of the T cells. The T-cell engager trispecific antibodies can be used to activate HIV-1 reservoirs and redirect/activate T cells to lyse latently infected HIV-1+ T cells. Examples of target proteins on T cells include but are not limited to CD3 and CD28, among others. In some embodiments, the trispecific binding proteins may be generated by combining the antigen binding domains of two or more monospecific antibodies (parent antibodies) into one antibody. See International Publication Nos. WO 2011/038290 A2, WO 2013/086533 A1, WO 2013/070776 A1, WO 2012/154312 A1, and WO 2013/163427 A1. The binding proteins of the disclosure may be prepared using domains or sequences obtained or derived from any human or non-human antibody, including, for example, human, murine, or humanized antibodies.

In some embodiments of the disclosure, the trivalent binding protein is capable of binding three different antigen targets. In one embodiment, the binding protein is trispecific and one light chain-heavy chain pair is capable of binding two different antigen targets or epitopes and one light chain-heavy chain pair is capable of binding one antigen target or epitope.

In some embodiments, a binding protein of the present disclosure binds one or more HIV target proteins and one or more T cell target proteins. In some embodiments, the binding protein is capable of specifically binding one HIV target protein and two different epitopes on a single T cell target protein. In some embodiments, the binding protein is capable of specifically binding one HIV target protein and two different T cell target proteins (e.g., CD28 and CD3). In some embodiments, the first and second polypeptide chains of the binding protein form two antigen binding sites that specifically target two T cell target proteins, and the third and fourth polypeptide chains of the binding protein form an antigen binding site that specifically binds an HIV target protein. In some embodiments, the one or more HIV target proteins are one or more of glycoprotein 120, glycoprotein 41, and glycoprotein 160. In some embodiments, the one or more T cell target proteins are one or more of CD3 and CD28.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:362 or an amino acid sequence that is at least 95% identical to the amino acid sequence of SEQ ID NO:362; the second polypeptide chain comprises the amino acid sequence of SEQ ID NO:363 or an amino acid sequence that is at least 95% identical to the amino acid sequence of SEQ ID NO:363; the third polypeptide chain comprises the amino acid sequence of SEQ ID NO:364 or an amino acid sequence that is at least 95% identical to the amino acid sequence of SEQ ID NO:364; and the fourth polypeptide chain comprises the amino acid sequence of SEQ ID NO:365 or an amino acid sequence that is at least 95% identical to the amino acid sequence of SEQ ID NO:365.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:366 or an amino acid sequence that is at least 95% identical to the amino acid sequence of SEQ ID NO:366; the second polypeptide chain comprises the amino acid sequence of SEQ ID NO:367 or an amino acid sequence that is at least 95% identical to the amino acid sequence of SEQ ID NO:367; the third polypeptide chain comprises the amino acid sequence of SEQ ID NO:368 or an amino acid sequence that is at least 95% identical to the amino acid sequence of SEQ ID NO:368; and the fourth polypeptide chain comprises the amino acid sequence of SEQ ID NO:369 or an amino acid sequence that is at least 95% identical to the amino acid sequence of SEQ ID NO:369.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:370 or an amino acid sequence that is at least 95% identical to the amino acid sequence of SEQ ID NO:370; the second polypeptide chain comprises the amino acid sequence of SEQ ID NO:371 or an amino acid sequence that is at least 95% identical to the amino acid sequence of SEQ ID NO:371; the third polypeptide chain comprises the amino acid sequence of SEQ ID NO:372 or an amino acid sequence that is at least 95% identical to the amino acid sequence of SEQ ID NO:372; and the fourth polypeptide chain comprises the amino acid sequence of SEQ ID NO:373 or an amino acid sequence that is at least 95% identical to the amino acid sequence of SEQ ID NO:373.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:374 or an amino acid sequence that is at least 95% identical to the amino acid sequence of SEQ ID NO:374; the second polypeptide chain comprises the amino acid sequence of SEQ ID NO:375 or an amino acid sequence that is at least 95% identical to the amino acid sequence of SEQ ID NO:375; the third polypeptide chain comprises the amino acid sequence of SEQ ID NO:376 or an amino acid sequence that is at least 95% identical to the amino acid sequence of SEQ ID NO:376; and the fourth polypeptide chain comprises the amino acid sequence of SEQ ID NO:377 or an amino acid sequence that is at least 95% identical to the amino acid sequence of SEQ ID NO:377.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:378 or an amino acid sequence that is at least 95% identical to the amino acid sequence of SEQ ID NO:378; the second polypeptide chain comprises the amino acid sequence of SEQ ID NO:379 or an amino acid sequence that is at least 95% identical to the amino acid sequence of SEQ ID NO:379; the third polypeptide chain comprises the amino acid sequence of SEQ ID NO:380 or an amino acid sequence that is at least 95% identical to the amino acid sequence of SEQ ID NO:380; and the fourth polypeptide chain comprises the amino acid sequence of SEQ ID NO:381 or an amino acid sequence that is at least 95% identical to the amino acid sequence of SEQ ID NO:381.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:382 or an amino acid sequence that is at least 95% identical to the amino acid sequence of SEQ ID NO:382; the second polypeptide chain comprises the amino acid sequence of SEQ ID NO:383 or an amino acid sequence that is at least 95% identical to the amino acid sequence of SEQ ID NO:383; the third polypeptide chain comprises the amino acid sequence of SEQ ID NO:384 or an amino acid sequence that is at least 95% identical to the amino acid sequence of SEQ ID NO:384; and the fourth polypeptide chain comprises the amino acid sequence of SEQ ID NO:385 or an amino acid sequence that is at least 95% identical to the amino acid sequence of SEQ ID NO:385.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:386 or an amino acid sequence that is at least 95% identical to the amino acid sequence of SEQ ID NO:386; the second polypeptide chain comprises the amino acid sequence of SEQ ID NO:387 or an amino acid sequence that is at least 95% identical to the amino acid sequence of SEQ ID NO:387; the third polypeptide chain comprises the amino acid sequence of SEQ ID NO:388 or an amino acid sequence that is at least 95% identical to the amino acid sequence of SEQ ID NO:388; and the fourth polypeptide chain comprises the amino acid sequence of SEQ ID NO:389 or an amino acid sequence that is at least 95% identical to the amino acid sequence of SEQ ID NO:389.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:390 or an amino acid sequence that is at least 95% identical to the amino acid sequence of SEQ ID NO:390; the second polypeptide chain comprises the amino acid sequence of SEQ ID NO:391 or an amino acid sequence that is at least 95% identical to the amino acid sequence of SEQ ID NO:391; the third polypeptide chain comprises the amino acid sequence of SEQ ID NO:392 or an amino acid sequence that is at least 95% identical to the amino acid sequence of SEQ ID NO:392; and the fourth polypeptide chain comprises the amino acid sequence of SEQ ID NO:393 or an amino acid sequence that is at least 95% identical to the amino acid sequence of SEQ ID NO:393.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:394 or an amino acid sequence that is at least 95% identical to the amino acid sequence of SEQ ID NO:394; the second polypeptide chain comprises the amino acid sequence of SEQ ID NO:395 or an amino acid sequence that is at least 95% identical to the amino acid sequence of SEQ ID NO:395; the third polypeptide chain comprises the amino acid sequence of SEQ ID NO:396 or an amino acid sequence that is at least 95% identical to the amino acid sequence of SEQ ID NO:396; and the fourth polypeptide chain comprises the amino acid sequence of SEQ ID NO:397 or an amino acid sequence that is at least 95% identical to the amino acid sequence of SEQ ID NO:397.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:398 or an amino acid sequence that is at least 95% identical to the amino acid sequence of SEQ ID NO:398; the second polypeptide chain comprises the amino acid sequence of SEQ ID NO:399 or an amino acid sequence that is at least 95% identical to the amino acid sequence of SEQ ID NO:399; the third polypeptide chain comprises the amino acid sequence of SEQ ID NO:400 or an amino acid sequence that is at least 95% identical to the amino acid sequence of SEQ ID NO:400; and the fourth polypeptide chain comprises the amino acid sequence of SEQ ID NO:401 or an amino acid sequence that is at least 95% identical to the amino acid sequence of SEQ ID NO:401.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:402 or an amino acid sequence that is at least 95% identical to the amino acid sequence of SEQ ID NO:402; the second polypeptide chain comprises the amino acid sequence of SEQ ID NO:403 or an amino acid sequence that is at least 95% identical to the amino acid sequence of SEQ ID NO:403; the third polypeptide chain comprises the amino acid sequence of SEQ ID NO:404 or an amino acid sequence that is at least 95% identical to the amino acid sequence of SEQ ID NO:404; and the fourth polypeptide chain comprises the amino acid sequence of SEQ ID NO:405 or an amino acid sequence that is at least 95% identical to the amino acid sequence of SEQ ID NO:405.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:406 or an amino acid sequence that is at least 95% identical to the amino acid sequence of SEQ ID NO:406; the second polypeptide chain comprises the amino acid sequence of SEQ ID NO:407 or an amino acid sequence that is at least 95% identical to the amino acid sequence of SEQ ID NO:407; the third polypeptide chain comprises the amino acid sequence of SEQ ID NO:408 or an amino acid sequence that is at least 95% identical to the amino acid sequence of SEQ ID NO:408; and the fourth polypeptide chain comprises the amino acid sequence of SEQ ID NO:409 or an amino acid sequence that is at least 95% identical to the amino acid sequence of SEQ ID NO:409.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:410 or an amino acid sequence that is at least 95% identical to the amino acid sequence of SEQ ID NO:410; the second polypeptide chain comprises the amino acid sequence of SEQ ID NO:411 or an amino acid sequence that is at least 95% identical to the amino acid sequence of SEQ ID NO:411; the third polypeptide chain comprises the amino acid sequence of SEQ ID NO:412 or an amino acid sequence that is at least 95% identical to the amino acid sequence of SEQ ID NO:412; and the fourth polypeptide chain comprises the amino acid sequence of SEQ ID NO:413 or an amino acid sequence that is at least 95% identical to the amino acid sequence of SEQ ID NO:413.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:414 or an amino acid sequence that is at least 95% identical to the amino acid sequence of SEQ ID NO:414; the second polypeptide chain comprises the amino acid sequence of SEQ ID NO:415 or an amino acid sequence that is at least 95% identical to the amino acid sequence of SEQ ID NO:415; the third polypeptide chain comprises the amino acid sequence of SEQ ID NO:416 or an amino acid sequence that is at least 95% identical to the amino acid sequence of SEQ ID NO:416; and the fourth polypeptide chain comprises the amino acid sequence of SEQ ID NO:417 or an amino acid sequence that is at least 95% identical to the amino acid sequence of SEQ ID NO:417.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:418 or an amino acid sequence that is at least 95% identical to the amino acid sequence of SEQ ID NO:418; the second polypeptide chain comprises the amino acid sequence of SEQ ID NO:419 or an amino acid sequence that is at least 95% identical to the amino acid sequence of SEQ ID NO:419; the third polypeptide chain comprises the amino acid sequence of SEQ ID NO:420 or an amino acid sequence that is at least 95% identical to the amino acid sequence of SEQ ID NO:420; and the fourth polypeptide chain comprises the amino acid sequence of SEQ ID NO:421 or an amino acid sequence that is at least 95% identical to the amino acid sequence of SEQ ID NO:421.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:422 or an amino acid sequence that is at least 95% identical to the amino acid sequence of SEQ ID NO:422; the second polypeptide chain comprises the amino acid sequence of SEQ ID NO:423 or an amino acid sequence that is at least 95% identical to the amino acid sequence of SEQ ID NO:423; the third polypeptide chain comprises the amino acid sequence of SEQ ID NO:424 or an amino acid sequence that is at least 95% identical to the amino acid sequence of SEQ ID NO:424; and the fourth polypeptide chain comprises the amino acid sequence of SEQ ID NO:425 or an amino acid sequence that is at least 95% identical to the amino acid sequence of SEQ ID NO:425.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:430 or an amino acid sequence that is at least 95% identical to the amino acid sequence of SEQ ID NO:430; the second polypeptide chain comprises the amino acid sequence of SEQ ID NO:431 or an amino acid sequence that is at least 95% identical to the amino acid sequence of SEQ ID NO:431; the third polypeptide chain comprises the amino acid sequence of SEQ ID NO:432 or an amino acid sequence that is at least 95% identical to the amino acid sequence of SEQ ID NO:432; and the fourth polypeptide chain comprises the amino acid sequence of SEQ ID NO:433 or an amino acid sequence that is at least 95% identical to the amino acid sequence of SEQ ID NO:433.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:434 or an amino acid sequence that is at least 95% identical to the amino acid sequence of SEQ ID NO:434; the second polypeptide chain comprises the amino acid sequence of SEQ ID NO:435 or an amino acid sequence that is at least 95% identical to the amino acid sequence of SEQ ID NO:435; the third polypeptide chain comprises the amino acid sequence of SEQ ID NO:436 or an amino acid sequence that is at least 95% identical to the amino acid sequence of SEQ ID NO:436; and the fourth polypeptide chain comprises the amino acid sequence of SEQ ID NO:437 or an amino acid sequence that is at least 95% identical to the amino acid sequence of SEQ ID NO:437.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:438 or an amino acid sequence that is at least 95% identical to the amino acid sequence of SEQ ID NO:438; the second polypeptide chain comprises the amino acid sequence of SEQ ID NO:439 or an amino acid sequence that is at least 95% identical to the amino acid sequence of SEQ ID NO:439; the third polypeptide chain comprises the amino acid sequence of SEQ ID NO:440 or an amino acid sequence that is at least 95% identical to the amino acid sequence of SEQ ID NO:440; and the fourth polypeptide chain comprises the amino acid sequence of SEQ ID NO:441 or an amino acid sequence that is at least 95% identical to the amino acid sequence of SEQ ID NO:441.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:442 or an amino acid sequence that is at least 95% identical to the amino acid sequence of SEQ ID NO:442; the second polypeptide chain comprises the amino acid sequence of SEQ ID NO:443 or an amino acid sequence that is at least 95% identical to the amino acid sequence of SEQ ID NO:443; the third polypeptide chain comprises the amino acid sequence of SEQ ID NO:444 or an amino acid sequence that is at least 95% identical to the amino acid sequence of SEQ ID NO:444; and the fourth polypeptide chain comprises the amino acid sequence of SEQ ID NO:445 or an amino acid sequence that is at least 95% identical to the amino acid sequence of SEQ ID NO:445.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:446 or an amino acid sequence that is at least 95% identical to the amino acid sequence of SEQ ID NO:446; the second polypeptide chain comprises the amino acid sequence of SEQ ID NO:447 or an amino acid sequence that is at least 95% identical to the amino acid sequence of SEQ ID NO:447; the third polypeptide chain comprises the amino acid sequence of SEQ ID NO:448 or an amino acid sequence that is at least 95% identical to the amino acid sequence of SEQ ID NO:448; and the fourth polypeptide chain comprises the amino acid sequence of SEQ ID NO:449 or an amino acid sequence that is at least 95% identical to the amino acid sequence of SEQ ID NO:449.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:450 or an amino acid sequence that is at least 95% identical to the amino acid sequence of SEQ ID NO:450; the second polypeptide chain comprises the amino acid sequence of SEQ ID NO:451 or an amino acid sequence that is at least 95% identical to the amino acid sequence of SEQ ID NO:451; the third polypeptide chain comprises the amino acid sequence of SEQ ID NO:452 or an amino acid sequence that is at least 95% identical to the amino acid sequence of SEQ ID NO:452; and the fourth polypeptide chain comprises the amino acid sequence of SEQ ID NO:453 or an amino acid sequence that is at least 95% identical to the amino acid sequence of SEQ ID NO:453.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:454 or an amino acid sequence that is at least 95% identical to the amino acid sequence of SEQ ID NO:454; the second polypeptide chain comprises the amino acid sequence of SEQ ID NO:455 or an amino acid sequence that is at least 95% identical to the amino acid sequence of SEQ ID NO:455; the third polypeptide chain comprises the amino acid sequence of SEQ ID NO:456 or an amino acid sequence that is at least 95% identical to the amino acid sequence of SEQ ID NO:456; and the fourth polypeptide chain comprises the amino acid sequence of SEQ ID NO:457 or an amino acid sequence that is at least 95% identical to the amino acid sequence of SEQ ID NO:457.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:458 or an amino acid sequence that is at least 95% identical to the amino acid sequence of SEQ ID NO:458; the second polypeptide chain comprises the amino acid sequence of SEQ ID NO:459 or an amino acid sequence that is at least 95% identical to the amino acid sequence of SEQ ID NO:459; the third polypeptide chain comprises the amino acid sequence of SEQ ID NO:460 or an amino acid sequence that is at least 95% identical to the amino acid sequence of SEQ ID NO:460; and the fourth polypeptide chain comprises the amino acid sequence of SEQ ID NO:461 or an amino acid sequence that is at least 95% identical to the amino acid sequence of SEQ ID NO:461.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:462 or an amino acid sequence that is at least 95% identical to the amino acid sequence of SEQ ID NO:462; the second polypeptide chain comprises the amino acid sequence of SEQ ID NO:463 or an amino acid sequence that is at least 95% identical to the amino acid sequence of SEQ ID NO:463; the third polypeptide chain comprises the amino acid sequence of SEQ ID NO:464 or an amino acid sequence that is at least 95% identical to the amino acid sequence of SEQ ID NO:464; and the fourth polypeptide chain comprises the amino acid sequence of SEQ ID NO:465 or an amino acid sequence that is at least 95% identical to the amino acid sequence of SEQ ID NO:465.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:466 or an amino acid sequence that is at least 95% identical to the amino acid sequence of SEQ ID NO:466; the second polypeptide chain comprises the amino acid sequence of SEQ ID NO:467 or an amino acid sequence that is at least 95% identical to the amino acid sequence of SEQ ID NO:467; the third polypeptide chain comprises the amino acid sequence of SEQ ID NO:468 or an amino acid sequence that is at least 95% identical to the amino acid sequence of SEQ ID NO:468; and the fourth polypeptide chain comprises the amino acid sequence of SEQ ID NO:469 or an amino acid sequence that is at least 95% identical to the amino acid sequence of SEQ ID NO:469.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:470 or an amino acid sequence that is at least 95% identical to the amino acid sequence of SEQ ID NO:470; the second polypeptide chain comprises the amino acid sequence of SEQ ID NO:471 or an amino acid sequence that is at least 95% identical to the amino acid sequence of SEQ ID NO:471; the third polypeptide chain comprises the amino acid sequence of SEQ ID NO:472 or an amino acid sequence that is at least 95% identical to the amino acid sequence of SEQ ID NO:472; and the fourth polypeptide chain comprises the amino acid sequence of SEQ ID NO:473 or an amino acid sequence that is at least 95% identical to the amino acid sequence of SEQ ID NO:473.

In some embodiments, a binding protein of the present disclosure comprises four polypeptide chains that form three antigen binding sites that specifically bind one or more HIV target proteins, wherein the first polypeptide chain comprises the amino acid sequence of SEQ ID NO:474 or an amino acid sequence that is at least 95% identical to the amino acid sequence of SEQ ID NO:474; the second polypeptide chain comprises the amino acid sequence of SEQ ID NO:475 or an amino acid sequence that is at least 95% identical to the amino acid sequence of SEQ ID NO:475; the third polypeptide chain comprises the amino acid sequence of SEQ ID NO:476 or an amino acid sequence that is at least 95% identical to the amino acid sequence of SEQ ID NO:476; and the fourth polypeptide chain comprises the amino acid sequence of SEQ ID NO:477 or an amino acid sequence that is at least 95% identical to the amino acid sequence of SEQ ID NO:477.

Exemplary and non-limiting polypeptides that may find use in any of the trispecific binding proteins described herein are provided in Table 4A.

Anti-HIV Binding Sites

Certain aspects of the present disclosure relate to binding proteins that comprise an antigen binding site that binds an HIV target protein or polypeptide.

In some embodiments, the HIV target protein is glycoprotein 120, glycoprotein 41, or glycoprotein 160. In some embodiments, a binding protein binds one or more of: glycoprotein 120, glycoprotein 41, and glycoprotein 160. Exemplary HIV target proteins include, without limitation, MPER of the HIV-1 gp41 protein, a CD4 binding site of the HIV-1 gp120 protein, a glycan in the V3 loop of the HIV-1 gp120 protein, or a trimer apex of the HIV-1 gp120 protein or gp160. For example, in some embodiments, a binding protein of the present disclosure comprises an antigen binding site that binds a CD4 binding site of the HIV-1 gp120 protein. Exemplary antigen binding sites that bind HIV target proteins contemplated for use herein include, without limitation, those described in International Publication No. WO2017/074878, such as those from antibodies CD4BS "a", CD4BS "b", MPER, MPER_100W, V1/V2 "a", V1/V2 "b", or V3.

In some embodiments, a binding protein comprising an antigen binding site that binds an HIV target protein is monospecific and/or monovalent, bispecific and/or bivalent, trispecific and/or trivalent, or multispecific and/or multivalent. In some embodiments, a binding protein that comprises an antigen binding site that binds an HIV target protein is a trispecific binding protein comprising four polypeptides that form three antigen binding sites.

In some embodiments, a binding protein of the present disclosure comprises an antigen binding site comprising: an antibody heavy chain variable (VH) domain comprising a CDR-H1 sequence comprising the amino acid sequence of NCPIN (SEQ ID NO:302) a CDR-H2 sequence comprising the amino acid sequence of WMKPRHGAVSYARQLQG (SEQ ID NO:303), and a CDR-H3 sequence comprising the amino acid sequence of GKYCTARDYYNWDFEH (SEQ ID NO:304); and/or an antibody light chain variable (VL) domain comprising a CDR-L1 sequence comprising the amino acid sequence of RTSQYGSLA (SEQ ID NO:305), a CDR-L2 sequence comprising the amino acid sequence of SGSTRAA (SEQ ID NO:306), and a CDR-L3 sequence comprising the amino acid sequence of QQYEF (SEQ ID NO:307). In some embodiments, a binding protein of the present disclosure comprises an antigen binding site comprising: an antibody heavy chain variable (VH) domain comprising a CDR-H1 sequence comprising the amino acid sequence of NCPIN (SEQ ID NO:302) a CDR-H2 sequence comprising the amino acid sequence of WMKPRHGAVSYARQLQG (SEQ ID NO:303), and a CDR-H3 sequence comprising the amino acid sequence of GKYCTARDYYNWDFEH (SEQ ID NO:304); and an antibody light chain variable (VL) domain comprising a CDR-L1 sequence comprising the amino acid sequence of RTSQYGSLA (SEQ ID NO:305), a CDR-L2 sequence comprising the amino acid sequence of SGSTRAA (SEQ ID NO:306), and a CDR-L3 sequence comprising the amino acid sequence of QQYEF (SEQ ID NO:307).

In some embodiments, a binding protein of the present disclosure comprises an antigen binding site comprising: an antibody heavy chain variable (VH) domain comprising a CDR-H1 sequence comprising the amino acid sequence of GYTFTAHI (SEQ ID NO:308) a CDR-H2 sequence comprising the amino acid sequence of IKPQYGAV (SEQ ID NO:309) or IKPQYGAT (SEQ ID NO:310); and/or an antibody light chain variable (VL) domain comprising a CDR-L1 sequence comprising the amino acid sequence of QGVGSD (SEQ ID NO:312), a CDR-L2 sequence comprising the amino acid sequence of HTS (SEQ ID NO:313), and a CDR-L3 sequence comprising the amino acid sequence of CQVLQF (SEQ ID NO:314). In some embodiments, a binding protein of the present disclosure comprises an antigen binding site comprising: an antibody heavy chain variable (VH) domain comprising a CDR-H1 sequence comprising the amino acid sequence of GYTFTAHI (SEQ ID NO:308) a CDR-H2 sequence comprising the amino acid sequence of IKPQYGAV (SEQ ID NO:309) or IKPQYGAT (SEQ ID NO:310); and an antibody light chain variable (VL) domain comprising a CDR-L1 sequence comprising the amino acid sequence of QGVGSD (SEQ ID NO:312), a CDR-L2 sequence comprising the amino acid sequence of HTS (SEQ ID NO:313), and a CDR-L3 sequence comprising the amino acid sequence of CQVLQF (SEQ ID NO:314). In some embodiments, a binding protein of the present disclosure comprises an antigen binding site comprising: an antibody heavy chain variable (VH) domain comprising a CDR-H1 sequence comprising the amino acid sequence of GYTFTAHI (SEQ ID NO:308) a CDR-H2 sequence comprising the amino acid sequence of IKPQYGAV (SEQ ID NO:309); and/or an antibody light chain variable (VL) domain comprising a CDR-L1 sequence comprising the amino acid sequence of QGVGSD (SEQ ID NO:312), a CDR-L2 sequence comprising the amino acid sequence of HTS (SEQ ID NO:313), and a CDR-L3 sequence comprising the amino acid sequence of CQVLQF (SEQ ID NO:314). In some embodiments, a binding protein of the present disclosure comprises an antigen binding site comprising: an antibody heavy chain variable (VH) domain comprising a CDR-H1 sequence comprising the amino acid sequence of GYTFTAHI (SEQ ID NO:308) a CDR-H2 sequence comprising the amino acid sequence of IKPQYGAV (SEQ ID NO:309); and an antibody light chain variable (VL) domain comprising a CDR-L1 sequence comprising the amino acid sequence of QGVGSD (SEQ ID NO:312), a CDR-L2 sequence comprising the amino acid sequence of HTS (SEQ ID NO:313), and a CDR-L3 sequence comprising the amino acid sequence of CQVLQF (SEQ ID NO:314). In some embodiments, a binding protein of the present disclosure comprises an antigen binding site comprising: an antibody heavy chain variable (VH) domain comprising a CDR-H1 sequence comprising the amino acid sequence of GYTFTAHI (SEQ ID NO:308) a CDR-H2 sequence comprising the amino acid sequence of IKPQYGAT (SEQ ID NO:310); and/or an antibody light chain variable (VL) domain comprising a CDR-L1 sequence comprising the amino acid sequence of QGVGSD (SEQ ID NO:312), a CDR-L2 sequence comprising the amino acid sequence of HTS (SEQ ID NO:313), and a CDR-L3 sequence comprising the amino acid sequence of CQVLQF (SEQ ID NO:314). In some embodiments, a binding protein of the present disclosure comprises an antigen binding site comprising: an antibody heavy chain variable (VH) domain comprising a CDR-H1 sequence comprising the amino acid sequence of GYTFTAHI (SEQ ID NO:308) a CDR-H2 sequence comprising the amino acid sequence of IKPQYGAT (SEQ ID NO:310); and an antibody light chain variable (VL) domain comprising a CDR-L1 sequence comprising the amino acid sequence of QGVGSD (SEQ ID NO:312), a CDR-L2 sequence comprising the amino acid sequence of HTS (SEQ ID NO:313), and a CDR-L3 sequence comprising the amino acid sequence of CQVLQF (SEQ ID NO:314).

In some embodiments, a binding protein of the present disclosure comprises an antigen binding site comprising: an antibody heavy chain variable (VH) domain comprising a CDR-H1 sequence comprising the amino acid sequence of DCTLN (SEQ ID NO:315) a CDR-H2 sequence comprising the amino acid sequence of WLKPRWGAVNYARPLQG (SEQ ID NO:316), and a CDR-H3 sequence comprising the amino acid sequence of GKNCDYNWDFEH (SEQ ID NO:317); and/or an antibody light chain variable (VL) domain comprising a CDR-L1 sequence comprising the amino acid sequence of RTSQYGSLA (SEQ ID NO:318), a CDR-L2 sequence comprising the amino acid sequence of SGSTRAA (SEQ ID NO:319), and a CDR-L3 sequence comprising the amino acid sequence of QQYEF (SEQ ID NO:320). In some embodiments, a binding protein of the present disclosure comprises an antigen binding site comprising: an antibody heavy chain variable (VH) domain comprising a CDR-H1 sequence comprising the amino acid sequence of DCTLN (SEQ ID NO:315) a CDR-H2 sequence comprising the amino acid sequence of WLKPRWGAVNYARPLQG (SEQ ID NO:316), and a CDR-H3 sequence comprising the amino acid sequence of GKNCDYNWDFEH (SEQ ID NO:317); and an antibody light chain variable (VL) domain comprising a CDR-L1 sequence comprising the amino acid sequence of RTSQYGSLA (SEQ ID NO:318), a CDR-L2 sequence comprising the amino acid sequence of SGSTRAA (SEQ ID NO:319), and a CDR-L3 sequence comprising the amino acid sequence of QQYEF (SEQ ID NO:320).

In some embodiments, a binding protein of the present disclosure comprises an antigen binding site with a VH domain comprising an extended heavy chain FR3 loop of antibody VRC03, e.g., as described in Liu, Q. et al. (2019) *Nat. Commun.* 10:721.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVRLSQSGGQMKKPGDSMRISCRASGYEFINCPINWIRLAPGKRPEWMGWMKPRHG AVSYARQLQGRVTMTRDMYSETAFLELRSLTSDDTAVYFCTRGKYCTARDYYNWD FEHWGQGTPVTVSS (SEQ ID NO:344), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of SLTQSPGTLSLSPGETAIISCRTSQYGSLAWYQQRPGQAPRLVIYSGSTRAAGIPDRFS GSRWGPDYNLTISNLESGDFGVYYCQQYEFFGQGTKVQVDIK (SEQ ID NO:346). In some embodiments, a binding protein of the present disclosure comprises an antigen binding site comprising: an antibody heavy chain variable (VH) domain comprising the amino acid sequence of SEQ ID NO:344, and/or an antibody light chain variable (VL) domain comprising the amino acid sequence of SEQ ID NO:346. In some embodiments, a binding protein of the present disclosure comprises an antigen binding site comprising: an antibody heavy chain variable (VH) domain comprising the amino acid sequence of SEQ ID NO:344, and an antibody light chain variable (VL) domain comprising the amino acid sequence of SEQ ID NO:346.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVRLSQSGGQMKKPGDSMRISCRASGYEFINCPINWIRLAPGKRPEWMGWMKPRHG AVSYARQLQGRVTMTRQLSQDPDDPDWGTAFLELRSLTSDDTAVYFCTRGKYCTA RDYYNWDFEHWGQGTPVTVSS (SEQ ID NO:345), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of SLTQSPGTLSLSPGETAIISCRTSQYGSLAWYQQRPGQAPRLVIYSGSTRAAGIPDRFS GSRWGPDYNLTISNLESGDFGVYYCQQYEFFGQGTKVQVDIK (SEQ ID NO:346). In some embodiments, a binding protein of the present disclosure comprises an antigen binding site comprising: an antibody heavy chain variable (VH) domain comprising the amino acid sequence of SEQ ID NO:345, and/or an antibody light chain variable (VL) domain comprising the amino acid sequence of SEQ ID NO:346. In some embodiments, a binding protein of the present disclosure comprises an antigen binding site comprising: an antibody heavy chain variable (VH) domain comprising the amino acid sequence of SEQ ID NO:345, and an antibody light chain variable (VL) domain comprising the amino acid sequence of SEQ ID NO:346.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of RAHLVQSGTAMKKPGASVRVSCQTSGYTFTAHILFWFRQAPGRGLEWVGWIKPQY GAVNFGGGFRDRVTLTRDVYREIAYMDIRGLKPDDTAVYYCARDRSYGDSSWALD AWGQGTTVVVSA (SEQ ID NO:347), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of YIHVTQSPSSLSVSIGDRVTINCQTSQGVGSDLHWYQHKPGRAPKLLIHHTSSVEDGV PSRFSGSGFHTSFNLTISDLQADDI- ATYYCQVLQFFGRGSRLHIK (SEQ ID NO:350). In some embodiments, a binding protein of the present disclosure comprises an antigen binding site comprising: an antibody heavy chain variable (VH) domain comprising the amino acid sequence of SEQ ID NO:347, and/or an antibody light chain variable (VL) domain comprising the amino acid sequence of SEQ ID NO:350. In some embodiments, a binding protein of the present disclosure comprises an antigen binding site comprising: an antibody heavy chain variable (VH) domain comprising the amino acid sequence of SEQ ID NO:347, and an antibody light chain variable (VL) domain comprising the amino acid sequence of SEQ ID NO:350.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of RAHLVQSGTAMKKPGASVRVSCQTSGYTFTAHILFWFRQAPGRGLEWVGWIKPQY GATNFGGGFRDRVTLTRDVYREIAYMDIRGLKPDDTAVYYCARDRSYGDSSWALD AWGQGTTVVVSA (SEQ ID NO:348), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of YIHVTQSPSSLSVSIGDRVTINCQTSQGVGSDLHWY QHKPGRAPKLLIHHTSSVEDGV PSRFSGSGFHTSFNLTISDLQADDIATYYCQVLQFFGRGSRLHIK (SEQ ID NO:350). In some embodiments, a binding protein of the present disclosure comprises an antigen binding site comprising: an antibody heavy chain variable (VH) domain comprising the amino acid sequence of SEQ ID NO:348, and/or an antibody light chain variable (VL) domain comprising the amino acid sequence of SEQ ID NO:350. In some embodiments, a binding protein of the present disclosure comprises an antigen binding site comprising: an antibody heavy chain variable (VH) domain comprising the amino acid sequence of SEQ ID NO:348, and an antibody light chain variable (VL) domain comprising the amino acid sequence of SEQ ID NO:350.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of RAHLVQSGTAMKKPGASVRVSCQTSGYTFTAHILFWFRQAPGRGLEWVGWIKPQY GAVNFGGGFRDRVTLTRQLSQDPDDPDWGIAYMDIRGLKPDDTAVYYCARDRSYG DSSWALDAWGQGTTVVVSA (SEQ ID NO:349), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of YIHVTQSPSSLSVSIGDRVTINCQTSQGVGSDLHWYQHKPGRAPKLLIHHTSSVEDGV PSRFSGSGFHTSFNLTISDLQADDIATYYCQVLQFFGRGSRLHIK (SEQ ID NO:350). In some embodiments, a binding protein of the present disclosure comprises an antigen binding site comprising: an antibody heavy chain variable (VH) domain comprising the amino acid sequence of SEQ ID NO:349, and/or an antibody light chain variable (VL) domain comprising the amino acid sequence of SEQ ID NO:350. In some embodiments, a binding protein of the present disclosure comprises an antigen binding site comprising: an antibody heavy chain variable (VH) domain comprising the amino acid sequence of SEQ ID NO:349, and an antibody light chain variable (VL) domain comprising the amino acid sequence of SEQ ID NO:350.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVQSGGQMKKPGESMRISCRASGYEFIDCTLNWIRLAPGKRPEWMGWLKPRW GAVNYARPLQGRVTMTRQLSQDPDDPDWGTAFLELRSLTVDDTAVYFCTRGKNCD YNWDFEHWGRGTPVIVSS (SEQ ID NO:351), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of LTQSPGTLSLSPGETAIISCRTSQYGSLAWYQQRPGQAPRLVIYSGSTRAAGIPDRFSG SRWGPDYNLTISNLESGDFGVYYCQQYEFFGQGTKVQVDIK (SEQ ID NO:352). In some embodiments, a binding protein of the present disclosure comprises an antigen binding site comprising: an antibody heavy chain variable (VH) domain comprising the amino acid sequence of SEQ ID NO:351, and/or an antibody light chain variable (VL) domain comprising the amino acid sequence of SEQ ID NO:352. In some embodiments, a binding protein of the present disclosure comprises an antigen binding site comprising: an antibody heavy chain variable (VH) domain comprising the amino acid sequence of SEQ ID NO:351, and an antibody light chain variable (VL) domain comprising the amino acid sequence of SEQ ID NO:352.

In some embodiments of any of the above embodiments, the binding protein is a trispecific binding protein. In some embodiments, the trispecific binding protein comprising an antigen binding site that binds an HIV target protein, an antigen binding site that binds a CD28 polypeptide, and an antigen binding site that binds a CD3 polypeptide. In some embodiments, the binding protein is a trispecific binding protein comprising four polypeptides comprising three antigen binding sites, wherein the polypeptide of formula I and the polypeptide of formula II form a cross-over light chain-heavy chain pair (e.g., as described herein). In some embodiments, the VH and VL domains of any of the anti-CD38 antigen binding sites described above represent $V_{H3}$ and $V_{L3}$ and form a third antigen binding site that binds an HIV target protein. In some embodiments, $V_{H1}$ and $V_{L1}$ form a first antigen binding site that binds a CD28 polypeptide, $V_{H2}$ and $V_{L2}$ form a second antigen binding site that binds a CD3 polypeptide, and the VH and VL domains of any of the anti-HIV antigen binding sites described above and/or in Table 1A represent $V_{H3}$ and $V_{L3}$ and form a third antigen binding site that binds an HIV target protein.

Sequences of exemplary anti-HIV antigen binding sites are provided in Table 1A. In some embodiments, a binding protein comprising an anti-HIV antigen binding site of the present disclosure comprises 1, 2, 3, 4, 5, or all 6 CDR sequences of an anti-HIV antibody described in Table 1A. In some embodiments, a binding protein comprising an anti-HIV antigen binding site of the present disclosure comprises VH domain sequence and/or VL domain sequence of an anti-HIV antibody described in Table 1A.

TABLE 1A

Anti-HIV binding protein sequences.

| Sequence Type | Molecule | Description | SEQ ID NO | Sequence |
|---|---|---|---|---|
| CDR | VRC07_523 (anti-Env gp120 CD4bs) | CDR-H1 | 302 | NCPIN |
| | | CDR-H2 | 303 | WMKPRHGAVSYARQLQG |
| | | CDR-H3 | 304 | GKYCTARDYYNWDFEH |
| | | CDR-L1 | 305 | RTSQYGSLA |
| | | CDR-L2 | 306 | SGSTRAA |
| | | CDR-L3 | 307 | QQYEF |
| | N6 (anti-Env gp120 CD4bs) | CDR-H1 | 308 | GYTFTAHI |
| | | CDR-H2 Original | 309 | IKPQYGAV |
| | | CDR-H2 rw52 | 310 | IKPQYGAT |
| | | CDR-H3 | 311 | DRSYGDSSWALDA |
| | | CDR-L1 | 312 | QGVGSD |
| | | CDR-L2 | 313 | HTS |
| | | CDR-L3 | 314 | CQVLQF |
| | VRC01.23 | CDR-H1 | 315 | DCTLN |
| | | CDR-H2 | 316 | WLKPRWGAVNYARPLQG |
| | | CDR-H3 | 317 | GKNCDYNWDFEH |
| | | CDR-L1 | 318 | RTSQYGSLA |
| | | CDR-L2 | 319 | SGSTRAA |
| | | CDR-L3 | 320 | QQYEF |
| Variable domain | VRC07_523 | VH | 344 | QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSS |
| | | FR3-03 VH | 345 | QVRLSQSGGQMKKPGDSMRISCRASGYEFINCPINWIRLAPGKRPEWMGWMKPRHGAVSYARQLQGRVTMTRQLSQDPDDPDWGTAFLELRSLTSDDTAVYFCTRGKYCTARDYYNWDFEHWGQGTPVTVSS |
| | | VL | 346 | SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK |
| | N6 | VH | 347 | RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSA |
| | | rw52 VH | 348 | RAHLVQSGTAMKKPGASVRVSCQTSGYTFTAHILFWFRQAPGRGLEWVGWIKPQYGATNFGGGFRDRVTLTRDVYREIAYMDIRGLKPDDTAVYYCARDRSYGDSSWALDAWGQGTTVVVSA |
| | | FR3-03 VH | 349 | RAHLVQSGTAMKKPGASVRVSCQTSGYTFTAHILFWFRQAPGRGLEWVGWIKPQYGAVNFGGGFRDRVTLTRQLSQDPDDPDWGIAYMDIRGLKPDDTAVYYCARDRSYGDSSWALDAWGQGTTVVVSA |
| | | VL | 350 | YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIK |
| | VRC01.23 | VH | 351 | QVQLVQSGGQMKKPGESMRISCRASGYEFIDCTLNWIRLAPGKRPEWMGWLKPRWGAVNYARPLQGRVTMTRQLSQDPDDPDWGTAFLELRSLTVDDTAVYFCTRGKNCDYNWDFEHWGRGTPVIVSS |
| | | VL | 352 | LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK |

Anti-CD28 Binding Sites

Certain aspects of the present disclosure relate to binding proteins that comprise an antigen binding site that binds a CD28 polypeptide. In some embodiments, the CD28 polypeptide is a human CD28 polypeptide, also known as Tp44. Human CD28 polypeptides are known in the art and include, without limitation, the polypeptides represented by NCBI Accession Numbers XP_011510499.1, XP_011510497.1, XP_011510496.1, NP_001230007.1, NP_001230006.1, or NP_006130.1, or a polypeptide produced from NCBI Gene ID Number 940. In some embodiments, a binding protein comprising an antigen binding site that binds a CD28 polypeptide is monospecific and/or monovalent, bispecific and/or bivalent, trispecific and/or trivalent, or multispecific and/or multivalent. In some embodiments, a binding protein that comprises an antigen binding site that binds a CD28 polypeptide is a trispecific binding protein comprising four polypeptides that form three antigen binding sites. In some embodiments, a binding protein that comprises an antigen binding site that binds a CD28 polypeptide is a trispecific binding protein comprising four polypeptides that form three antigen binding sites, one of which binds a CD28 polypeptide, and one of which binds a CD3 polypeptide. In some embodiments, a binding protein that comprises an antigen binding site that binds a CD28 polypeptide is a trispecific binding protein comprising four polypeptides that form three antigen binding sites, one of which binds a CD28 polypeptide, one of which binds a CD3 polypeptide, and one of which binds an HIV target protein.

In some embodiments, a binding protein of the present disclosure comprises an antigen binding site comprising: an antibody heavy chain variable (VH) domain comprising a CDR-H1 sequence comprising the amino acid sequence of GYTFTSYY (SEQ ID NO:332), a CDR-H2 sequence comprising the amino acid sequence of IYPGNVNT (SEQ ID NO:333), and a CDR-H3 sequence comprising the amino acid sequence of TRSHYGLDWNFDV (SEQ ID NO:334); and/or an antibody light chain variable (VL) domain comprising a CDR-L1 sequence comprising the amino acid sequence of QNIYVW (SEQ ID NO:335), a CDR-L2 sequence comprising the amino acid sequence of KAS (SEQ ID NO:336), and a CDR-L3 sequence comprising the amino acid sequence of QQGQTYPY (SEQ ID NO:337). In some embodiments, a binding protein of the present disclosure comprises an antigen binding site comprising: an antibody heavy chain variable (VH) domain comprising a CDR-H1 sequence comprising the amino acid sequence of GYTFTSYY (SEQ ID NO:332), a CDR-H2 sequence comprising the amino acid sequence of IYPGNVNT (SEQ ID NO:333), and a CDR-H3 sequence comprising the amino acid sequence of TRSHYGLDWNFDV (SEQ ID NO:334); and an antibody light chain variable (VL) domain comprising a CDR-L1 sequence comprising the amino acid sequence of QNIYVW (SEQ ID NO:335), a CDR-L2 sequence comprising the amino acid sequence of KAS (SEQ ID NO:336), and a CDR-L3 sequence comprising the amino acid sequence of QQGQTYPY (SEQ ID NO:337).

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWG KGTTVTVSS (SEQ ID NO:360), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIK (SEQ ID NO:361). In some embodiments, a binding protein of the present disclosure comprises an antigen binding site comprising: an antibody heavy chain variable (VH) domain comprising the amino acid sequence of SEQ ID NO:360, and/or an antibody light chain variable (VL) domain comprising the amino acid sequence of SEQ ID NO:361. In some embodiments, a binding protein of the present disclosure comprises an antigen binding site comprising: an antibody heavy chain variable (VH) domain comprising the amino acid sequence of SEQ ID NO:360, and an antibody light chain variable (VL) domain comprising the amino acid sequence of SEQ ID NO:361.

In some embodiments of any of the above embodiments, the binding protein is a trispecific binding protein. In some embodiments, the trispecific binding protein comprising an antigen binding site that binds an HIV target protein, an antigen binding site that binds a CD28 polypeptide, and an antigen binding site that binds a CD3 polypeptide. In some embodiments, the binding protein is a trispecific binding protein comprising four polypeptides comprising three antigen binding sites, wherein the polypeptide of formula I and the polypeptide of formula II form a cross-over light chain-heavy chain pair (e.g., as described herein). In some embodiments, the VH and VL domains of any of the anti-CD28 antigen binding sites described above represent $V_{H1}$ and $V_{L1}$ and form a first antigen binding site that binds a CD28 polypeptide. In some embodiments, the VH and VL domains of any of the anti-CD28 antigen binding sites described above represent $V_{H1}$ and $V_{L1}$ and form a first antigen binding site that binds a CD28 polypeptide, $V_{H2}$ and $V_{L2}$ form a second antigen binding site that binds a CD3 polypeptide, and $V_{H3}$ and $V_{L3}$ and form a third antigen binding site that binds an HIV target protein.

Sequences of exemplary anti-CD28 antigen binding sites are provided in Table 2. In some embodiments, a binding protein comprising an anti-CD28 antigen binding site of the present disclosure comprises 1, 2, 3, 4, 5, or all 6 CDR sequences of an anti-CD28 antibody described in Table 2A. In some embodiments, a binding protein comprising an anti-CD28 antigen binding site of the present disclosure comprises a VH domain sequence and/or VL domain sequence of an anti-CD28 antibody described in Table 2A.

TABLE 2A

Anti-CD28 binding protein sequences.

| Sequence Type | Molecule | Description | SEQ ID NO | Sequence |
|---|---|---|---|---|
| CDR | Anti-CD28 (sup) | CDR-H1 | 332 | GYTFTSYY |
| | | CDR-H2 | 333 | IYPGNVNT |
| | | CDR-H3 | 334 | TRSHYGLDWNFDV |
| | | CDR-L1 | 335 | QNIYVW |
| | | CDR-L2 | 336 | KAS |
| | | CDR-L3 | 337 | QQGQTYPY |
| Variable Domain | Anti-CD28 (sup) | VH | 360 | QVQLVQSGAEVVKPGASVKVSCKAS GYTFTSYYIHWVRQAPGQGLEWIGSI YPGNVNTNYAQKFQGRATLTVDTSIS TAYMELSRLRSDDTAVYYCTRSHYG LDWNFDVWGKGTTVTVSS |
| | | VL | 361 | DIQMTQSPSSLSASVGDRVTITCQASQ NIYVWLNWYQQKPGKAPKLLIYKAS NLHTGVPSRFSGSGSGTDFTLTISSLQP EDIATYYCQQGQTYPYTFGQGTKLEI K |

Anti-CD3 Binding Sites

Certain aspects of the present disclosure relate to binding proteins that comprise an antigen binding site that binds a CD3 polypeptide. In some embodiments, the CD3 polypeptide is a human CD3 polypeptide, including CD3-delta (also known as T3D), IMD19, and CD3-DELTA), CD3-epsilon (also known as T3E, IMD18, and TCRE), and CD3-gamma (also known as T3G, IMD17, and CD3-GAMMA). Human CD3 polypeptides are known in the art and include, without limitation, the polypeptides represented by NCBI Accession Numbers XP_006510029.1 or NP_031674.1, or a polypeptide produced from NCBI Gene ID Numbers 915, 916, or 917. In some embodiments, a binding protein comprising an antigen binding site that binds a CD3 polypeptide is monospecific and/or monovalent, bispecific and/or bivalent, trispecific and/or trivalent, or multispecific and/or multivalent. In some embodiments, a binding protein that comprises an antigen binding site that binds a CD3 polypeptide is a trispecific binding protein comprising four polypeptides that form three antigen binding sites. In some embodiments, a binding protein that comprises an antigen binding site that binds a CD3 polypeptide is a trispecific binding protein comprising four polypeptides that form three antigen binding sites, one of which binds a CD28 polypeptide, and one of which binds a CD3 polypeptide. In some embodiments, a binding protein that comprises an antigen binding site that binds a CD3 polypeptide is a trispecific binding protein comprising four polypeptides that form three antigen binding sites, one of which binds a CD28 polypeptide, one of which binds a CD3 polypeptide, and one of which binds an HIV target protein.

In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and/or an antibody light chain variable (VL) domain comprising a CDR-L1 sequence comprising the amino acid sequence of QSLVHX$_1$NX$_2$X$_3$TY, wherein X$_1$ is E or Q, X$_2$ is A or L, and X$_3$ is Q, R, or F (SEQ ID NO:594), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, the CDR-L1 sequence of the $V_{L2}$ domain comprises an amino acid sequence selected from the group consisting of QSLVHQNAQTY (SEQ ID NO:325), QSLVHENLQTY (SEQ ID NO:326), QSLVHENLFTY (SEQ ID NO:327), and QSLVHENLRTY (SEQ ID NO:328).

In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and/or an antibody light chain variable (VL) domain comprising a CDR-L1 sequence comprising the amino acid sequence of QSLVHQNAQTY (SEQ ID NO:325), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and an antibody light chain variable (VL) domain comprising a CDR-L1 sequence comprising the amino acid sequence of QSLVHQNAQTY (SEQ ID NO:325), a CDR-L2 sequence comprising the amino acid sequence of KVS (SEQ ID NO:330), and a CDR-L3 sequence comprising the amino acid sequence of GQGTQYPFT (SEQ ID NO:331).

In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323);

and/or an antibody light chain variable (VL) domain comprising a CDR-L1 sequence comprising the amino acid sequence of QSLVHENLQTY (SEQ ID NO:326), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and an antibody light chain variable (VL) domain comprising a CDR-L1 sequence comprising the amino acid sequence of QSLVHENLQTY (SEQ ID NO:326), a CDR-L2 sequence comprising the amino acid sequence of KVS (SEQ ID NO:330), and a CDR-L3 sequence comprising the amino acid sequence of GQGTQYPFT (SEQ ID NO:331).

In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and/or an antibody light chain variable (VL) domain comprising a CDR-L1 sequence comprising the amino acid sequence of QSLVHENLFTY (SEQ ID NO:327), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and an antibody light chain variable (VL) domain comprising a CDR-L1 sequence comprising the amino acid sequence of QSLVHENLFTY (SEQ ID NO:327), a CDR-L2 sequence comprising the amino acid sequence of KVS (SEQ ID NO:330), and a CDR-L3 sequence comprising the amino acid sequence of GQGTQYPFT (SEQ ID NO:331).

In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and/or an antibody light chain variable (VL) domain comprising a CDR-L1 sequence comprising the amino acid sequence of QSLVHENLRTY (SEQ ID NO:328), a CDR-L2 sequence comprising the amino acid sequence of KVS (SEQ ID NO:330), and a CDR-L3 sequence comprising the amino acid sequence of GQGTQYPFT (SEQ ID NO:331). In some embodiments, a binding protein of the present disclosure comprises an antigen binding site comprising: an antibody heavy chain variable (VH) domain comprising a CDR-H1 sequence comprising the amino acid sequence of GFTFTKAW (SEQ ID NO:321), a CDR-H2 sequence comprising the amino acid sequence of IKDKSNSYAT (SEQ ID NO:322), and a CDR-H3 sequence comprising the amino acid sequence of RGVYYALSPFDY (SEQ ID NO:323); and an antibody light chain variable (VL) domain comprising a CDR-L1 sequence comprising the amino acid sequence of QSLVHENLRTY (SEQ ID NO:328), a CDR-L2 sequence comprising the amino acid sequence of KVS (SEQ ID NO:330), and a CDR-L3 sequence comprising the amino acid sequence of GQGTQYPFT (SEQ ID NO:331).

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVES-GGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:353), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to an amino acid sequence selected from the group consisting of DIVMTQTPLSLSVTPGQPASISCKSSQSLVHQNAQ-TYLSWYLQKPGQSPQSLIYKVSN RFSGVPDRFSGSGSGTDFTLKISRVEAE-DVGVYYCGQGTQYPFTFGSGTKVEIK (SEQ ID NO:355), DIVMTQTPLSLSVTPGQPASISCK-SSQSLVHENLQTYLSWYLQKPGQSPQSLIYKVSN RFSGVPDRFSGSGSGTDFTLKISRVEAE-DVGVYYCGQGTQYPFTFGSGTKVEIK (SEQ ID NO:356), DIVMTQTPLSLSVTPGQPASISCK-SSQSLVHENLFTYLSWYLQKPGQSPQSLIYKVSNR FSGVPDRFSGSGSGTDFTLKISRVEAE-DVGVYYCGQGTQYPFTFGSGTKVEIK (SEQ ID NO:357), and DIVMTQTPLSLSVTPGQPASISCK-SSQSLVHENLRTYLSWYLQKPGQSPQSLIYKVSN RFSGVPDRFSGSGSGTDFTLKISRVEAE-DVGVYYCGQGTQYPFTFGSGTKVEIK (SEQ ID NO:358). In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising an amino acid sequence selected from the group consisting of SEQ ID NO:355, SEQ ID NO:356, SEQ ID NO:357, and SEQ ID NO:358. In some embodiments, a binding protein of the present disclosure comprises an antigen binding site comprising: an antibody heavy chain variable (VH) domain comprising the amino acid sequence of SEQ ID NO:353, and an antibody light chain variable (VL) domain comprising an amino acid sequence selected from the group consisting of SEQ ID NO:355, SEQ ID NO:356, SEQ ID NO:357, and SEQ ID NO:358.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVES- GGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:353), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHQNAQ-TYLSWYLQKPGQSPQSLIYKVSN RFSGVPDRFSGSGSGTDFTLKISRVEAE-DVGVYYCGQGTQYPFTFGSGTKVEIK (SEQ ID NO:355). In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:355. In some embodiments, a binding protein of the present disclosure comprises an antigen binding site comprising: an antibody heavy chain variable (VH) domain comprising the amino acid sequence of SEQ ID NO:353, and an antibody light chain variable (VL) domain comprising the amino acid sequence of SEQ ID NO:355.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVES-GGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:353), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHENLQ-TYLSWYLQKPGQSPQSLIYKVSN RFSGVPDRFSGSGSGTDFTLKISRVEAE-DVGVYYCGQGTQYPFTFGSGTKVEIK (SEQ ID NO:356). In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:356. In some embodiments, a binding protein of the present disclosure comprises an antigen binding site comprising: an antibody heavy chain variable (VH) domain comprising the amino acid sequence of SEQ ID NO:353, and an antibody light chain variable (VL) domain comprising the amino acid sequence of SEQ ID NO:356.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVES-GGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:353), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHENLF-TYLSWYLQKPGQSPQSLIYKVSNR FSGVPDRFSGSGSGTDFTLKISRVEAE-DVGVYYCGQGTQYPFTFGSGTKVEIK (SEQ ID NO:357). In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:357. In some embodiments, a binding protein of the present disclosure comprises an antigen binding site comprising: an antibody heavy chain variable (VH) domain comprising the amino acid sequence of SEQ ID NO:353, and an antibody light chain variable (VL) domain comprising the amino acid sequence of SEQ ID NO:357.

In some embodiments, a binding protein of the present disclosure comprises an antigen binding site comprising: an antibody heavy chain variable (VH) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of QVQLVES-GGGVVQPGRSLRLS-CAASGFTFTKAWMHWVRQAPGKQLEWVAQIKDKS NSYATYYADSVKGRFTISRDDSKNTLYLQMNSLRAE-DTAVYYCRGVYYALSPFDY WGQGTLVTVSS (SEQ ID NO:353), and/or an antibody light chain variable (VL) domain comprising an amino acid sequence that is at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the amino acid sequence of DIVMTQTPLSLSVTPGQPASISCKSSQSLVHENLR-TYLSWYLQKPGQSPQSLIYKVSN RFSGVPDRFSGSGSGTDFTLKISRVEAE-DVGVYYCGQGTQYPFTFGSGTKVEIK (SEQ ID NO:358). In some embodiments, a binding protein of the present disclosure comprises an antigen binding site comprising: an antibody heavy chain variable (VH) domain comprising the amino acid sequence of SEQ ID NO:353, and/or an antibody light chain variable (VL) domain comprising the amino acid sequence of SEQ ID NO:358. In some embodiments, a binding protein of the present disclosure comprises an antigen binding site comprising: an antibody heavy chain variable (VH) domain comprising the amino acid sequence of SEQ ID NO:353, and an antibody light chain variable (VL) domain comprising the amino acid sequence of SEQ ID NO:358.

Advantageously, anti-CD3 binding sites are described herein with high affinity binding to human CD3 polypeptides and potential manufacturing liabilities (e.g., deamidation sites) removed.

In some embodiments of any of the above embodiments, the binding protein is a trispecific binding protein. In some embodiments, the trispecific binding protein comprising an antigen binding site that binds an HIV target protein, an antigen binding site that binds a CD28 polypeptide, and an antigen binding site that binds a CD3 polypeptide. In some embodiments, the binding protein is a trispecific binding protein comprising four polypeptides comprising three antigen binding sites, wherein the polypeptide of formula I and the polypeptide of formula II form a cross-over light chain-heavy chain pair (e.g., as described herein). In some embodiments, the VH and VL domains of any of the anti-CD3 antigen binding sites described above represent $V_{H2}$ and $V_{L2}$ and form a second antigen binding site that binds a CD3 polypeptide. In some embodiments, $V_{H1}$ and $V_{L1}$ form a first antigen binding site that binds a CD28 polypeptide, the VH and VL domains of any of the anti-CD3 antigen binding sites described above and/or in Table 3 represent $V_{H2}$ and $V_{L2}$ and form a second antigen binding site that binds a CD3 polypeptide, and $V_{H3}$ and $V_{L3}$ form a third antigen binding site that binds an HIV target protein.

Sequences of exemplary anti-CD3 antigen binding sites are provided in Table 3. In some embodiments, a binding protein comprising an anti-CD3 antigen binding site of the present disclosure comprises 1, 2, 3, 4, 5, or all 6 CDR sequences of an anti-CD3 antibody described in Table 3A. In some embodiments, a binding protein comprising an anti-CD3 antigen binding site of the present disclosure comprises a VH domain sequence and/or VL domain sequence of an anti-CD3 antibody described in Table 3A.

TABLE 3A

Anti-CD3 binding protein sequences.

| Sequence Type | Molecule | Description | SEQ ID NO | Sequence |
|---|---|---|---|---|
| CDR | Anti-CD3 (mid) | CDR-H1 original | 321 | GFTFTKAW |
| | | CDR-H2 original | 322 | IKDKSNSYAT |
| | | CDR-H3 original | 323 | RGVYYALSPFDY |
| | | CDR-L1 original | 324 | QSLVHNNANTY |
| | | CDR-L1 QQ | 325 | QSLVHQNAQTY |
| | | CDR-L1 ENLQ | 326 | QSLVHENLQTY |
| | | CDR-L1 ENLF | 327 | QSLVHENLFTY |
| | | CDR-L1 ENLR | 328 | QSLVHENLRTY |
| | | CDR-L1 DNAQ | 329 | QSLVHDNAQTY |
| | | CDR-L2 original | 330 | KVS |
| | | CDR-L3 Original | 331 | GQGTQYPFT |
| | | consensus CDR-L1 | 594 | QSLVHX$_1$NX$_2$X$_3$TY, wherein X$_1$ is E or Q, X$_2$ is A or L, and X$_3$ is Q, R, or F |
| Variable domain | Anti-CD3 (mid) | VH | 353 | QVQLVESGGGVVQPGRSLRLSCAASG FTFTKAWMHWVRQAPGKQLEWVAQ IKDKSNSYATYYADSVKGRFTISRDDS KNTLYLQMNSLRAEDTAVYYCRGVY YALSPFDYWGQGTLVTVSS |
| | | VL Original | 354 | DIVMTQTPLSLSVTPGQPASISCKSSQS LVHNNANTYLSWYLQKPGQSPQSLIY KVSNRFSGVPDRFSGSGSGTDFTLKIS RVEAEDVGVYYCGQGTQYPFTFGSG TKVEIK |
| | | VL 32/35 QQ | 355 | DIVMTQTPLSLSVTPGQPASISCKSSQS LVHQNAQTYLSWYLQKPGQSPQSLIY KVSNRFSGVPDRFSGSGSGTDFTLKIS RVEAEDVGVYYCGQGTQYPFTFGSG TKVEIK |
| | | VL ENLQ | 356 | DIVMTQTPLSLSVTPGQPASISCKSSQS LVHENLQTYLSWYLQKPGQSPQSLIY KVSNRFSGVPDRFSGSGSGTDFTLKIS RVEAEDVGVYYCGQGTQYPFTFGSG TKVEIK |
| | | VL ENLF | 357 | DIVMTQTPLSLSVTPGQPASISCKSSQS LVHENLFTYLSWYLQKPGQSPQSLIY KVSNRFSGVPDRFSGSGSGTDFTLKIS RVEAEDVGVYYCGQGTQYPFTFGSG TKVEIK |
| | | VL ENLR | 358 | DIVMTQTPLSLSVTPGQPASISCKSSQS LVHENLRTYLSWYLQKPGQSPQSLIY KVSNRFSGVPDRFSGSGSGTDFTLKIS RVEAEDVGVYYCGQGTQYPFTFGSG TKVEIK |
| | | VL DNAQ | 359 | DIVMTQTPLSLSVTPGQPASISCKSSQS LVHDNAQTYLSWYLQKPGQSPQSLIY KVSNRFSGVPDRFSGSGSGTDFTLKIS RVEAEDVGVYYCGQGTQYPFTFGSG TKVEIK |

Linkers

In some embodiments, the linkers $L_1$, $L_2$, $L_3$, and $L_4$ range from no amino acids (length=0) to about 100 amino acids long, or less than 100, 50, 40, 30, 20, or 15 amino acids or less. The linkers can also be 10, 9, 8, 7, 6, 5, 4, 3, 2, or 1 amino acids long. $L_1$, $L_2$, $L_3$, and $L_4$ in one binding protein may all have the same amino acid sequence or may all have different amino acid sequences.

Examples of suitable linkers include, for example, GGGGSGGGGS (SEQ ID NO:341), GGGGSGGGGSGGGGS (SEQ ID NO: 342), S, RT, TKGPS (SEQ ID NO: 340), GQPKAAP (SEQ ID NO: 339), GGSGSSGSGG (SEQ ID NO: 343), and DKTHT (SEQ ID NO:338), as well as those disclosed in International Publication Nos. WO2017/074878 and WO2017/180913. The examples listed above are not intended to limit the scope of the disclosure in any way, and linkers comprising randomly selected amino acids selected from the group consisting of valine, leucine, isoleucine, serine, threonine, lysine, arginine, histidine, aspartate, glutamate, asparagine, glutamine, glycine, and proline have been shown to be suitable in the binding proteins.

The identity and sequence of amino acid residues in the linker may vary depending on the type of secondary structural element necessary to achieve in the linker. For example, glycine, serine, and alanine are best for linkers having maximum flexibility. Some combination of glycine, proline, threonine, and serine are useful if a more rigid and extended linker is necessary. Any amino acid residue may be considered as a linker in combination with other amino acid residues to construct larger peptide linkers as necessary depending on the desired properties.

In some embodiments, the length of $L_1$ is at least twice the length of $L_3$. In some embodiments, the length of $L_2$ is at least twice the length of $L_4$. In some embodiments, the length of $L_1$ is at least twice the length of $L_3$, and the length of $L_2$ is at least twice the length of $L_4$. In some embodiments, $L_1$ is 3 to 12 amino acid residues in length, $L_2$ is 3 to 14 amino acid residues in length, $L_3$ is 1 to 8 amino acid residues in length, and $L_4$ is 1 to 3 amino acid residues in length. In some embodiments, $L_1$ is 5 to 10 amino acid residues in length, $L_2$ is 5 to 8 amino acid residues in length, $L_3$ is 1 to 5 amino acid residues in length, and $L_4$ is 1 to 2 amino acid residues in length. In some embodiments, $L_1$ is 7 amino acid residues in length, $L_2$ is 5 amino acid residues in length, $L_3$ is 1 amino acid residue in length, and $L_4$ is 2 amino acid residues in length.

In some embodiments, $L_1$, $L_2$, $L_3$ and $L_4$ each independently are zero amino acids in length or comprise a sequence selected from the group consisting of GGGGSGGGGS (SEQ ID NO:341), GGGGSGGGGSGGGGS (SEQ ID NO: 342), S, RT, TKGPS (SEQ ID NO: 340), GQPKAAP (SEQ ID NO: 339), and GGSGSSGSGG (SEQ ID NO: 42). In some embodiments, $L_1$, $L_2$, $L_3$ and $L_4$ each independently comprise a sequence selected from the group consisting of GGGGSGGGGS (SEQ ID NO:341), GGGGSGGGGSGGGGS (SEQ ID NO:342), S, RT, TKGPS (SEQ ID NO:340), GQPKAAP (SEQ ID NO: 339), and GGSGSSGSGG (SEQ ID NO:343). In some embodiments, $L_1$ comprises the sequence GQPKAAP (SEQ ID NO: 339), $L_2$ comprises the sequence TKGPS (SEQ ID NO:340), $L_3$ comprises the sequence S, and $L_4$ comprises the sequence RT.

In some embodiments, at least one of $L_1$, $L_2$, $L_3$ or $L_4$ comprises the sequence DKTHT (SEQ ID NO:338). In some embodiments, $L_1$, $L_2$, $L_3$ and $L_4$ comprise the sequence DKTHT (SEQ ID NO:338).

Fc Regions and Constant Domains

In some embodiments, a binding protein of the present disclosure comprises a second polypeptide chain further comprising an Fc region linked to $C_{H1}$, the Fc region comprising an immunoglobulin hinge region and $C_{H2}$ and $C_{H3}$ immunoglobulin heavy chain constant domains. In some embodiments, a binding protein of the present disclosure comprises a third polypeptide chain further comprising an Fc region linked to $C_{H1}$, the Fc region comprising an immunoglobulin hinge region and $C_{H2}$ and $C_{H3}$ immunoglobulin heavy chain constant domains. In some embodiments, a binding protein of the present disclosure comprises a second polypeptide chain further comprising an Fc region linked to $C_{H1}$, the Fc region comprising an immunoglobulin hinge region and $C_{H2}$ and $C_{H3}$ immunoglobulin heavy chain constant domains, and a third polypeptide chain further comprising an Fc region linked to $C_{H1}$, the Fc region comprising an immunoglobulin hinge region and $C_{H2}$ and $C_{H3}$ immunoglobulin heavy chain constant domains.

In some embodiments, a binding protein of the present disclosure comprises a full-length antibody heavy chain or a polypeptide chain comprising an Fc region. In some embodiments, the Fc region is a human Fc region, e.g., a human IgG1, IgG2, IgG3, or IgG4 Fc region. In some embodiments, the Fc region includes an antibody hinge, $C_{H1}$, $C_{H2}$, $C_{H3}$, and optionally $C_{H4}$ domains. In some embodiments, the Fc region is a human IgG1 Fc region. In some embodiments, the Fc region is a human IgG4 Fc region. In some embodiments, the Fc region includes one or more of the mutations described infra. In some embodiments, the Fc region is an Fc region of one of the heavy chain polypeptides (e.g., polypeptide 2 or 3) of a binding protein shown in Table 4. In some embodiments, the heavy chain constant region is a constant region of one of the heavy chain polypeptides (e.g., polypeptide 2 or 3) of a binding protein shown in Table 4. In some embodiments, the light chain constant region is a constant region of one of the light chain polypeptides (e.g., polypeptide 1 or 4) of a binding protein shown in Table 4A.

In some embodiments, a binding protein of the present disclosure includes one or two Fc variants. The term "Fc variant" as used herein refers to a molecule or sequence that is modified from a native Fc but still comprises a binding site for the salvage receptor, FcRn (neonatal Fc receptor). Exemplary Fc variants, and their interaction with the salvage receptor, are known in the art. Thus, the term "Fc variant" can comprise a molecule or sequence that is humanized from a non-human native Fc. Furthermore, a native Fc comprises regions that can be removed because they provide structural features or biological activity that are not required for the antibody-like binding proteins of the invention. Thus, the term "Fe variant" comprises a molecule or sequence that lacks one or more native Fc sites or residues, or in which one or more Fc sites or residues has be modified, that affect or are involved in: (1) disulfide bond formation, (2) incompatibility with a selected host cell, (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC).

In some embodiments, a binding protein of the present disclosure (e.g., a trispecific binding protein) comprises a "knob" mutation on the second polypeptide chain and a "hole" mutation on the third polypeptide chain. In some embodiments, a binding protein of the present disclosure comprises a "knob" mutation on the third polypeptide chain and a "hole" mutation on the second polypeptide chain. In some embodiments, the “knob” mutation comprises substitution(s) at positions corresponding to positions 354 and/or 366 of human IgG1 or IgG4 according to EU Index. In some embodiments, the amino acid substitutions are S354C, T366W, T366Y, S354C and T366W, or S354C and T366Y. In some embodiments, the “knob” mutation comprises substitutions at positions corresponding to positions 354 and 366 of human IgG1 or IgG4 according to EU Index. In some embodiments, the amino acid substitutions are S354C and T366W. In some embodiments, the “hole” mutation comprises substitution(s) at positions corresponding to positions 407 and, optionally, 349, 366, and/or 368 and of human IgG1 or IgG4 according to EU Index. In some embodiments, the amino acid substitutions are Y407V or Y407T and optionally Y349C, T366S, and/or L368A. In some embodiments, the “hole” mutation comprises substitutions at positions corresponding to positions 349, 366, 368, and 407 of human IgG1 or IgG4 according to EU Index. In some embodiments, the amino acid substitutions are Y349C, T366S, L368A, and Y407V.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution(s) at positions corresponding to positions 366 and optionally 354 of human IgG1 or IgG4 according to EU Index, wherein the amino acid substitutions are T366W or T366Y and optionally S354C; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution(s) at positions corresponding to positions 407 and optionally 349, 366, and/or 368 and of human IgG1 or IgG4 according to EU Index, wherein the amino acid substitutions are Y407V or Y407T and optionally Y349C, T366S, and/or L368A.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution(s) at positions corresponding to positions 407 and optionally 349, 366, and/or 368 and of human IgG1 or IgG4 according to EU Index, wherein the amino acid substitutions are Y407V or Y407T and optionally Y349C, T366S, and/or L368A; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution(s) at positions corresponding to positions 366 and optionally 354 of human IgG1 or IgG4 according to EU Index, wherein the amino acid substitutions are T366W or T366Y and optionally S354C.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution at position corresponding to position 366 of human IgG1 or IgG4 according to EU Index, wherein the amino acid substitution is T366W; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution(s) at positions corresponding to positions 366, 368, and/or 407 and of human IgG1 or IgG4 according to EU Index, wherein the amino acid substitutions are T366S, L368A, and/or Y407V.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitution(s) at positions corresponding to positions 366, 368, and/or 407 and of human IgG1 or IgG4 according to EU Index, wherein the amino acid substitutions are T366S, L368A, and/or Y407V; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitution at position corresponding to position 366 of human IgG1 or IgG4 according to EU Index, wherein the amino acid substitution is T366W.

In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitutions at positions corresponding to positions 354 and 366 of human IgG1 or IgG4 according to EU Index, wherein the amino acid substitutions are S354C and T366W; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitutions at positions corresponding to positions 349, 366, 368, and 407 of human IgG1 or IgG4 according to EU Index, wherein the amino acid substitutions are Y349C, T366S, L368A, and Y407V. In some embodiments, the second polypeptide chain further comprises a first Fc region linked to CH1, the first Fc region comprising an immunoglobulin hinge region and CH2 and CH3 immunoglobulin heavy chain constant domains, wherein the first Fc region comprises amino acid substitutions at positions corresponding to positions 349, 366, 368, and 407 of human IgG1 or IgG4 according to EU Index, wherein the amino acid substitutions are Y349C, T366S, L368A, and Y407V; and wherein the third polypeptide chain further comprises a second Fc region linked to CH1, the second Fc region comprising an immunoglobulin hinge region and CH2 and CH3 immunoglobulin heavy chain constant domains, wherein the second Fc region comprises amino acid substitutions at positions corresponding to positions 354 and 366 of human IgG1 or IgG4 according to EU Index, wherein the amino acid substitutions are S354C and T366W. In some embodiments, the first and/or second Fc regions are human IgG1 Fc regions. In some embodiments, the first and/or second Fc regions are human IgG4 Fc regions.

In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 354, 366, and 409 of human IgG4 according to EU Index, wherein the amino acid substitutions are S228P, S354C, T366W, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 349, 366, 368, 407, and 409 of human IgG4 according to EU Index, wherein the amino acid substitutions are S228P, Y349C, T366S, L368A, Y407V, and R409K. In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 349, 366, 368, 407, and 409 of human IgG4 according to EU Index, wherein the amino acid substitutions are S228P, Y349C, T366S, L368A, Y407V, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 354, 366, and 409 of human IgG4 according to EU Index, wherein the amino acid substitutions are S228P, S354C, T366W, and R409K.

In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 234, 235, 354, and 366 of human IgG4 according to EU Index, wherein the amino acid substitutions are F234A, L235A, S354C, and T366W; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 234, 235, 349, 366, 368, and 407 of human IgG4 according to EU Index, wherein the amino acid substitutions are F234A, L235A, Y349C, T366S, L368A, and Y407V. In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 234, 235, 349, 366, 368, and 407 of human IgG4 according to EU Index, wherein the amino acid substitutions are F234A, L235A, Y349C, T366S, L368A, and Y407V; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 234, 235, 354, and 366 of human IgG4 according to EU Index, wherein the amino acid substitutions are F234A, L235A, S354C, and T366W.

In some embodiments, a binding protein of the present disclosure comprises one or more mutations to reduce effector function, e.g., Fc receptor-mediated antibody-dependent cellular phagocytosis (ADCP), complement-dependent cytotoxicity (CDC), and/or antibody-dependent cellular cytotoxicity (ADCC). In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains; wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions are human IgG1 Fc regions; and wherein the first and the second Fc regions each comprise amino acid substitutions at positions corresponding to positions 234 and 235 of human IgG1 according to EU Index, wherein the amino acid substitutions are L234A and L235A. In some embodiments, the Fc regions of the second and the third polypeptide chains are human IgG1 Fc regions, and wherein the Fc regions each comprise amino acid substitutions at positions corresponding to positions 234 and 235 of human IgG1 according to EU Index, wherein the amino acid substitutions are L234A and L235A. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains; wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions are human IgG1 Fc regions; and wherein the first and the second Fc regions each comprise amino acid substitutions at positions corresponding to positions 234, 235, and 329 of human IgG1 according to EU Index, wherein the amino acid substitutions are L234A, L235A, and P329A. In some embodiments, the Fc regions of the second and the third polypeptide chains are human IgG1 Fc regions, and wherein the Fc regions each comprise amino acid substitutions at positions corresponding to positions 234, 235, and 329 of human IgG1 according to EU Index, wherein the amino acid substitutions are L234A, L235A, and P329A. In some embodiments, the Fc regions of the second and the third polypeptide chains are human IgG4 Fc regions, and the Fc regions each comprise amino acid substitutions at positions corresponding to positions 234 and 235 of human IgG4 according to EU Index, wherein the amino acid substitutions are F234A and L235A. In some embodiments, the binding protein comprises a second polypeptide chain further comprising a first Fc region linked to $C_{H1}$, the first Fc region comprising an immunoglobulin hinge region and $C_{H2}$ and $C_{H3}$ immunoglobulin heavy chain constant domains, and a third polypeptide chain further comprising a second Fc region linked to $C_{H1}$, the second Fc region comprising an immunoglobulin hinge region and $C_{H2}$ and $C_{H3}$ immunoglobulin heavy chain constant domains; and wherein the first and the second Fc regions each comprise amino acid substitutions at positions corresponding to positions 234 and 235 of human IgG4 according to EU Index, wherein the amino acid substitutions are F234A and L235A.

In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 234, 235, 354, 366, and 409 of human IgG4 according to EU Index, wherein the amino acid substitutions are S228P, F234A, L235A, S354C, T366W, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 234, 235, 349, 366, 368, 407, and 409 of human IgG4 according to EU Index, wherein the amino acid substitutions are S228P, F234A, L235A, Y349C, T366S, L368A, Y407V, and R409K. In some embodiments, the second polypeptide chain further comprises a first Fc region linked to CH1, wherein the first Fc region is a human IgG4 Fc region comprising an immunoglobulin hinge region and CH2 and CH3 immunoglobulin heavy chain constant domains, wherein the first Fc region comprises amino acid substitutions at positions corresponding to positions 228, 234, 235, 349, 366, 368, 407, and 409 of human IgG4 according to EU Index, wherein the amino acid substitutions are S228P, F234A, L235A, Y349C, T366S, L368A, Y407V, and R409K; and wherein the third polypeptide chain further comprises a second Fc region linked to CH1, wherein the second Fc region is a human IgG4 Fc region comprising an immunoglobulin hinge region and CH2 and CH3 immunoglobulin heavy chain constant domains, wherein the second Fc region comprises amino acid substitutions at positions corresponding to positions 228, 234, 235, 354, 366, and 409 of human IgG4 according to EU Index, wherein the amino acid substitutions are S228P, F234A, L235A, S354C, T366W, and R409K.

In some embodiments, the Fc region is a human IgG4 Fc region comprising one or more mutations that reduce or eliminate FcγI and/or FcγII binding. In some embodiments, the Fc region is a human IgG4 Fc region comprising one or more mutations that reduce or eliminate FcγI and/or FcγII binding but do not affect FcRn binding. In some embodiments, the Fc region is a human IgG4 Fc region comprising amino acid substitutions at positions corresponding to positions 228 and/or 409 of human IgG4 according to EU Index. In some embodiments, the amino acid substitutions are S228P and/or R409K. In some embodiments, the Fc region is a human IgG4 Fc region comprising amino acid substitutions at positions corresponding to positions 234 and/or 235 of human IgG4 according to EU Index. In some embodiments, the amino acid substitutions are F234A and/or L235A. In some embodiments, the Fc region is a human IgG4 Fc region comprising amino acid substitutions at positions corresponding to positions 228, 234, 235, and/or 409 of human IgG4 according to EU Index. In some embodiments, the amino acid substitutions are S228P, F234A, L235A, and/or R409K. In some embodiments, the Fc region is a human IgG4 Fc region comprising amino acid substitutions at positions corresponding to positions 233-236 of human IgG4 according to EU Index. In some embodiments, the amino acid substitutions are E233P, F234V, L235A, and a deletion at 236. In some embodiments, the Fc region is a human IgG4 Fc region comprising amino acid mutations at substitutions corresponding to positions 228, 233-236, and/or 409 of human IgG4 according to EU Index. In some embodiments, the amino acid mutations are S228P; E233P, F234V, L235A, and a deletion at 236; and/or R409K.

In some embodiments, the Fc region comprises one or more mutations that reduce or eliminate Fc receptor binding and/or effector function of the Fc region (e.g., Fc receptor-mediated antibody-dependent cellular phagocytosis (ADCP), complement-dependent cytotoxicity (CDC), and/or antibody-dependent cellular cytotoxicity (ADCC)).

In some embodiments, the Fc region is a human IgG1 Fc region comprising one or more amino acid substitutions at positions corresponding to positions 234, 235, and/or 329 of human IgG1 according to EU Index. In some embodiments, the amino acid substitutions are L234A, L235A, and/or P329A. In some embodiments, the Fc region is a human IgG1 Fc region comprising amino acid substitutions at positions corresponding to positions 298, 299, and/or 300 of human IgG1 according to EU Index. In some embodiments, the amino acid substitutions are S298N, T299A, and/or Y300S.

In some embodiments, a binding protein of the present disclosure comprises one or more mutations to improve stability, e.g., of the hinge region and/or dimer interface of IgG4 (See e.g., Spiess, C. et al. (2013) *J Biol. Chem.* 288:26583-26593). In some embodiments, the mutation comprises substitutions at positions corresponding to positions 228 and 409 of human IgG4 according to EU Index, wherein the amino acid substitutions are S228P and R409K. In some embodiments, the binding protein comprises a second polypeptide chain further comprising a first Fc region linked to $C_{H1}$, the first Fc region comprising an immunoglobulin hinge region and $C_{H2}$ and $C_{H3}$ immunoglobulin heavy chain constant domains, and a third polypeptide chain further comprising a second Fc region linked to $C_{H1}$, the second Fc region comprising an immunoglobulin hinge region and $C_{H2}$ and $C_{H3}$ immunoglobulin heavy chain constant domains; wherein the first and second Fc regions are human IgG4 Fc regions; and wherein the first and the second Fc regions each comprise amino acid substitutions at positions corresponding to positions 228 and 409 of human IgG4 according to EU Index, wherein the amino acid substitutions are S228P and R409K. In some embodiments, a binding protein of the present disclosure comprises knob and hole mutations and one or more mutations to improve stability. In some embodiments, the first and/or second Fc regions are human IgG4 Fc regions.

In some embodiments, the Fc region is a human IgG1 Fc region comprising one or more amino acid substitutions at positions corresponding to positions 234, 235, and/or 329 of human IgG1 according to EU Index. In some embodiments, the amino acid substitutions are L234A, L235A, and/or P329A. In some embodiments, the Fc region is a human IgG1 Fc region comprising amino acid substitutions at positions corresponding to positions 298, 299, and/or 300 of human IgG1 according to EU Index. In some embodiments, the amino acid substitutions are S298N, T299A, and/or Y300S.

Nucleic Acids

Other aspects of the present disclosure relate to isolated nucleic acid molecules comprising a nucleotide sequence encoding any of the binding proteins described herein. Exemplary and non-limiting nucleic acid sequences are provided in Table 5A.

Other aspects of the present disclosure relate to kits of polynucleotides, e.g., that encode one or more polypeptides of a binding protein as described herein. In some embodiments, a kit of polynucleotides of the present disclosure comprises one, two, three, or four polynucleotides of a kit of polynucleotides comprising: (a) a first polynucleotide comprising the polynucleotide sequence of SEQ ID NO:478, a second polynucleotide comprising the polynucleotide sequence of SEQ ID NO:479, a third polynucleotide comprising the polynucleotide sequence of SEQ ID NO:480, and a fourth polynucleotide comprising the polynucleotide sequence of SEQ ID NO:481; (b) a first polynucleotide comprising the polynucleotide sequence of SEQ ID NO:482, a second polynucleotide comprising the polynucleotide sequence of SEQ ID NO:483, a third polynucleotide comprising the polynucleotide sequence of SEQ ID NO:484, and a fourth polynucleotide comprising the polynucleotide sequence of SEQ ID NO:485; (c) a first polynucleotide comprising the polynucleotide sequence of SEQ ID NO:486, a second polynucleotide comprising the polynucleotide sequence of SEQ ID NO:487, a third polynucleotide comprising the polynucleotide sequence of SEQ ID NO:488, and a fourth polynucleotide comprising the polynucleotide sequence of SEQ ID NO:489; (d) a first polynucleotide comprising the polynucleotide sequence of SEQ ID NO:490, a second polynucleotide comprising the polynucleotide sequence of SEQ ID NO:491, a third polynucleotide comprising the polynucleotide sequence of SEQ ID NO:492, and a fourth polynucleotide comprising the polynucleotide sequence of SEQ ID NO:493; (e) a first polynucleotide comprising the polynucleotide sequence of SEQ ID NO:494, a second polynucleotide comprising the polynucleotide sequence of SEQ ID NO:495, a third polynucleotide comprising the polynucleotide sequence of SEQ ID NO:496, and a fourth polynucleotide comprising the polynucleotide sequence of SEQ ID NO:497; (f) a first polynucleotide comprising the polynucleotide sequence of SEQ ID NO:498, a second polynucleotide comprising the polynucleotide sequence of SEQ ID NO:499, a third polynucleotide comprising the polynucleotide sequence of SEQ ID NO:500, and a fourth polynucleotide comprising the polynucleotide sequence of SEQ ID NO:501; (g) a first polynucleotide comprising the polynucleotide sequence of SEQ ID NO:502, a second polynucleotide comprising the polynucleotide sequence of SEQ ID NO:503, a third polynucleotide comprising the polynucleotide sequence of SEQ ID NO:504, and a fourth polynucleotide comprising the polynucleotide sequence of SEQ ID NO:505; (h) a first polynucleotide comprising the polynucleotide sequence of SEQ ID NO:506, a second polynucleotide comprising the polynucleotide sequence of SEQ ID NO:507, a third polynucleotide comprising the polynucleotide sequence of SEQ ID NO:508, and a fourth polynucleotide comprising the polynucleotide sequence of SEQ ID NO:509; (i) a first polynucleotide comprising the polynucleotide sequence of SEQ ID NO:510, a second polynucleotide comprising the polynucleotide sequence of SEQ ID NO:511, a third polynucleotide comprising the polynucleotide sequence of SEQ ID NO:512, and a fourth polynucleotide comprising the polynucleotide sequence of SEQ ID NO:513; (j) a first polynucleotide comprising the polynucleotide sequence of SEQ ID NO:514, a second polynucleotide comprising the polynucleotide sequence of SEQ ID NO:515, a third polynucleotide comprising the polynucleotide sequence of SEQ ID NO:516, and a fourth polynucleotide comprising the polynucleotide sequence of SEQ ID NO:517; (k) a first polynucleotide comprising the polynucleotide sequence of SEQ ID NO:518, a second polynucleotide comprising the polynucleotide sequence of SEQ ID NO:519, a third polynucleotide comprising the polynucleotide sequence of SEQ ID NO:520, and a fourth polynucleotide comprising the polynucleotide sequence of SEQ ID NO:521; (l) a first polynucleotide comprising the polynucleotide sequence of SEQ ID NO:522, a second polynucleotide comprising the polynucleotide sequence of SEQ ID NO:523, a third polynucleotide comprising the polynucleotide sequence of SEQ ID NO:524, and a fourth polynucleotide comprising the polynucleotide sequence of SEQ ID NO:525; (m) a first polynucleotide comprising the polynucleotide sequence of SEQ ID NO:526, a second polynucleotide comprising the polynucleotide sequence of SEQ ID NO:527, a third polynucleotide comprising the polynucleotide sequence of SEQ ID NO:528, and a fourth polynucleotide comprising the polynucleotide sequence of SEQ ID NO:529; (n) a first polynucleotide comprising the polynucleotide sequence of SEQ ID NO:530, a second polynucleotide comprising the polynucleotide sequence of SEQ ID NO:531, a third polynucleotide comprising the polynucleotide sequence of SEQ ID NO:532, and a fourth polynucleotide comprising the polynucleotide sequence of SEQ ID NO:533; (o) a first polynucleotide comprising the polynucleotide sequence of SEQ ID NO:534, a second polynucleotide comprising the polynucleotide sequence of SEQ ID NO:535, a third polynucleotide comprising the polynucleotide sequence of SEQ ID NO:536, and a fourth polynucleotide comprising the polynucleotide sequence of SEQ ID NO:537; (p) a first polynucleotide comprising the polynucleotide sequence of SEQ ID NO:538, a second polynucleotide comprising the polynucleotide sequence of SEQ ID NO:539, a third polynucleotide comprising the polynucleotide sequence of SEQ ID NO:540, and a fourth polynucleotide comprising the polynucleotide sequence of SEQ ID NO:541; (q) a first polynucleotide comprising the polynucleotide sequence of SEQ ID NO:542, a second polynucleotide comprising the polynucleotide sequence of SEQ ID NO:543, a third polynucleotide comprising the polynucleotide sequence of SEQ ID NO:544, and a fourth polynucleotide comprising the polynucleotide sequence of SEQ ID NO:545; (r) a first polynucleotide comprising the polynucleotide sequence of SEQ ID NO:546, a second polynucleotide comprising the polynucleotide sequence of SEQ ID NO:547, a third polynucleotide comprising the polynucleotide sequence of SEQ ID NO:548, and a fourth polynucleotide comprising the polynucleotide sequence of SEQ ID NO:549; (s) a first polynucleotide comprising the polynucleotide sequence of SEQ ID NO:550, a second polynucleotide comprising the polynucleotide sequence of SEQ ID NO:551, a third polynucleotide comprising the polynucleotide sequence of SEQ ID NO:552, and a fourth polynucleotide comprising the polynucleotide sequence of SEQ ID NO:553; (t) a first polynucleotide comprising the polynucleotide sequence of SEQ ID NO:554, a second polynucleotide comprising the polynucleotide sequence of SEQ ID NO:555, a third polynucleotide comprising the polynucleotide sequence of SEQ ID NO:556, and a fourth polynucleotide comprising the polynucleotide sequence of SEQ ID NO:557; (u) a first polynucleotide comprising the polynucleotide sequence of SEQ ID NO:558, a second polynucleotide comprising the polynucleotide sequence of SEQ ID NO:559, a third polynucleotide comprising the polynucleotide sequence of SEQ ID NO:560, and a fourth polynucleotide comprising the polynucleotide sequence of SEQ ID NO:561; (v) a first polynucleotide comprising the polynucleotide sequence of SEQ ID NO:562, a second polynucleotide comprising the polynucleotide sequence of SEQ ID NO:563, a third polynucleotide comprising the polynucleotide sequence of SEQ ID NO:564, and a fourth polynucleotide comprising the polynucleotide sequence of SEQ ID NO:565; (w) a first polynucleotide comprising the polynucleotide sequence of SEQ ID NO:566, a second polynucleotide comprising the polynucleotide sequence of SEQ ID NO:567, a third polynucleotide comprising the polynucleotide sequence of SEQ ID NO:568, and a fourth polynucleotide comprising the polynucleotide sequence of SEQ ID NO:569; (x) a first polynucleotide comprising the polynucleotide sequence of SEQ ID NO:570, a second polynucleotide comprising the polynucleotide sequence of SEQ ID NO:571, a third polynucleotide comprising the polynucleotide sequence of SEQ ID NO:572, and a fourth polynucleotide comprising the polynucleotide sequence of SEQ ID NO:573; (y) a first polynucleotide comprising the polynucleotide sequence of SEQ ID NO:574, a second polynucleotide comprising the polynucleotide sequence of SEQ ID NO:575, a third polynucleotide comprising the polynucleotide sequence of SEQ ID NO:576, and a fourth polynucleotide comprising the polynucleotide sequence of SEQ ID NO:577; (z) a first polynucleotide comprising the polynucleotide sequence of SEQ ID NO:578, a second polynucleotide comprising the polynucleotide sequence of SEQ ID NO:579, a third polynucleotide comprising the polynucleotide sequence of SEQ ID NO:580, and a fourth polynucleotide comprising the polynucleotide sequence of SEQ ID NO:581; (aa) a first polynucleotide comprising the polynucleotide sequence of SEQ ID NO:582, a second polynucleotide comprising the polynucleotide sequence of SEQ ID NO:583, a third polynucleotide comprising the polynucleotide sequence of SEQ ID NO:584, and a fourth polynucleotide comprising the polynucleotide sequence of SEQ ID NO:585; (bb) a first polynucleotide comprising the polynucleotide sequence of SEQ ID NO:586, a second polynucleotide comprising the polynucleotide sequence of SEQ ID NO:587, a third polynucleotide comprising the polynucleotide sequence of SEQ ID NO:588, and a fourth polynucleotide comprising the polynucleotide sequence of SEQ ID NO:589; or (cc) a first polynucleotide comprising the polynucleotide sequence of SEQ ID NO:590, a second polynucleotide comprising the polynucleotide sequence of SEQ ID NO:591, a third polynucleotide comprising the polynucleotide sequence of SEQ ID NO:592, and a fourth polynucleotide comprising the polynucleotide sequence of SEQ ID NO:593.

Other aspects of the present disclosure relate to a vector system comprising one or more vectors encoding a first, second, third, and fourth polypeptide chain of any of the binding proteins described herein. In some embodiments, the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein, e.g., as shown in the polynucleotides of Table 5. In some embodiments, the vector system comprises a first vector encoding the first and second polypeptide chains of the binding protein, and a second vector encoding the third and fourth polypeptide chains of the binding protein. In some embodiments, the vector system comprises a first vector encoding the first and third polypeptide chains of the binding protein, and a second vector encoding the second and fourth polypeptide chains of the binding protein. In some embodiments, the vector system comprises a first vector encoding the first and fourth polypeptide chains of the binding protein, and a second vector encoding the second and third polypeptide chains of the binding protein. In some embodiments, the vector system comprises a first vector encoding the first, second, third, and fourth polypeptide chains of the binding protein. The one or more vectors of the vector system may be any of the vectors described herein. In some embodiments, the one or more vectors are expression vectors. In some embodiments, the first, second, third, and fourth polynucleotides are present on one or more expression vectors, e.g., one, two, three, or four expression vectors.

Standard recombinant DNA methodologies are used to construct the polynucleotides that encode the polypeptides which form the binding proteins, incorporate these polynucleotides into recombinant expression vectors, and introduce such vectors into host cells. See e.g., Sambrook et al., 2001, Molecular Cloning: a Laboratory Manual (Cold Spring Harbor Laboratory Press, 3rd ed.). Enzymatic reactions and purification techniques may be performed according to manufacturer's specifications, as commonly accomplished in the art, or as described herein. Unless specific definitions are provided, the nomenclature utilized in connection with, and the laboratory procedures and techniques of, analytical chemistry, synthetic organic chemistry, and medicinal and pharmaceutical chemistry described herein are those well-known and commonly used in the art. Similarly, conventional techniques may be used for chemical syntheses, chemical analyses, pharmaceutical preparation, formulation, delivery, and treatment of patients.

In some embodiments, the isolated nucleic acid is operably linked to a heterologous promoter to direct transcription of the binding protein-coding nucleic acid sequence. A promoter may refer to nucleic acid control sequences which direct transcription of a nucleic acid. A first nucleic acid sequence is operably linked to a second nucleic acid sequence when the first nucleic acid sequence is placed in a functional relationship with the second nucleic acid sequence. For instance, a promoter is operably linked to a coding sequence of a binding protein if the promoter affects the transcription or expression of the coding sequence. Examples of promoters may include, but are not limited to, promoters obtained from the genomes of viruses (such as polyoma virus, fowlpox virus, adenovirus (such as Adenovirus 2), bovine papilloma virus, avian sarcoma virus, cytomegalovirus, a retrovirus, hepatitis-B virus, Simian Virus 40 (SV40), and the like), from heterologous eukaryotic promoters (such as the actin promoter, an immunoglobulin promoter, from heat-shock promoters, and the like), the CAG-promoter (Niwa et al., Gene 108(2):193-9, 1991), the phosphoglycerate kinase (PGK)-promoter, a tetracycline-inducible promoter (Masui et al., Nucleic Acids Res. 33:e43, 2005), the lac system, the trp system, the tac system, the trc system, major operator and promoter regions of phage lambda, the promoter for 3-phosphoglycerate kinase, the promoters of yeast acid phosphatase, and the promoter of the yeast alpha-mating factors. Polynucleotides encoding binding proteins of the present disclosure may be under the control of a constitutive promoter, an inducible promoter, or any other suitable promoter described herein or other suitable promoter that will be readily recognized by one skilled in the art.

In some embodiments, the isolated nucleic acid is incorporated into a vector. In some embodiments, the vector is an expression vector. Expression vectors may include one or more regulatory sequences operatively linked to the polynucleotide to be expressed. The term "regulatory sequence" includes promoters, enhancers and other expression control elements (e.g., polyadenylation signals). Examples of suitable enhancers may include, but are not limited to, enhancer sequences from mammalian genes (such as globin, elastase, albumin, α-fetoprotein, insulin and the like), and enhancer sequences from a eukaryotic cell virus (such as SV40 enhancer on the late side of the replication origin (bp 100-270), the cytomegalovirus early promoter enhancer, the polyoma enhancer on the late side of the replication origin, adenovirus enhancers, and the like). Examples of suitable vectors may include, for example, plasmids, cosmids, episomes, transposons, and viral vectors (e.g., adenoviral, vaccinia viral, Sindbis-viral, measles, herpes viral, lentiviral, retroviral, adeno-associated viral vectors, etc.). Expression vectors can be used to transfect host cells, such as, for example, bacterial cells, yeast cells, insect cells, and mammalian cells. Biologically functional viral and plasmid DNA vectors capable of expression and replication in a host are known in the art, and can be used to transfect any cell of interest.

Host Cells

Other aspects of the present disclosure relate to a host cell (e.g., an isolated host cell) comprising one or more isolated polynucleotides, vectors, and/or vector systems described herein. In some embodiments, an isolated host cell of the present disclosure is cultured in vitro. In some embodiments, the host cell is a bacterial cell (e.g., an *E. coli* cell). In some embodiments, the host cell is a yeast cell (e.g., an *S. cerevisiae* cell). In some embodiments, the host cell is an insect cell. Examples of insect host cells may include, for example, *Drosophila* cells (e.g., S2 cells), *Trichoplusia ni* cells (e.g., High Five™ cells), and *Spodoptera frugiperda* cells (e.g., Sf21 or Sf9 cells). In some embodiments, the host cell is a mammalian cell. Examples of mammalian host cells may include, for example, human embryonic kidney cells (e.g., 293 or 293 cells subcloned for growth in suspension culture), Expi293™ cells, CHO cells, baby hamster kidney cells (e.g., BHK, ATCC CCL 10), mouse sertoli cells (e.g., TM4 cells), monkey kidney cells (e.g., CV1 ATCC CCL 70), African green monkey kidney cells (e.g., VERO-76, ATCC CRL-1587), human cervical carcinoma cells (e.g., HELA, ATCC CCL 2), canine kidney cells (e.g., MDCK, ATCC CCL 34), buffalo rat liver cells (e.g., BRL 3A, ATCC CRL 1442), human lung cells (e.g., W138, ATCC CCL 75), human liver cells (e.g., Hep G2, HB 8065), mouse mammary tumor cells (e.g., MMT 060562, ATCC CCL51), TRI cells, MRC 5 cells, FS4 cells, a human hepatoma line (e.g., Hep G2), and myeloma cells (e.g., NS0 and Sp2/0 cells).

Other aspects of the present disclosure relate to a method of producing any of the binding proteins described herein. In some embodiments, the method includes a) culturing a host cell (e.g., any of the host cells described herein) comprising an isolated nucleic acid, vector, and/or vector system (e.g., any of the isolated nucleic acids, vectors, and/or vector systems described herein) under conditions such that the host cell expresses the binding protein; and b) isolating the binding protein from the host cell. Methods of culturing host cells under conditions to express a protein are well known to one of ordinary skill in the art. Methods of isolating proteins from cultured host cells are well known to one of ordinary skill in the art, including, for example, by affinity chromatography (e.g., two step affinity chromatography comprising protein A affinity chromatography followed by size exclusion chromatography).

Pharmaceutical Compositions for Treating and/or Preventing HIV/AIDS

Therapeutic or pharmaceutical compositions comprising binding proteins are within the scope of the disclosure. Such therapeutic or pharmaceutical compositions can comprise a therapeutically effective amount of a binding protein, or binding protein-drug conjugate, in admixture with a pharmaceutically or physiologically acceptable formulation agent selected for suitability with the mode of administration.

Acceptable formulation materials are nontoxic to recipients at the dosages and concentrations employed.

The pharmaceutical composition can contain formulation materials for modifying, maintaining, or preserving, for example, the pH, osmolarity, viscosity, clarity, color, isotonicity, odor, sterility, stability, rate of dissolution or release, adsorption, or penetration of the composition. Suitable formulation materials include, but are not limited to, amino acids (such as glycine, glutamine, asparagine, arginine, or lysine), antimicrobials, antioxidants (such as ascorbic acid, sodium sulfite, or sodium hydrogen-sulfite), buffers (such as borate, bicarbonate, Tris-HCl, citrates, phosphates, or other organic acids), bulking agents (such as mannitol or glycine), chelating agents (such as ethylenediamine tetraacetic acid (EDTA)), complexing agents (such as caffeine, polyvinylpyrrolidone, beta-cyclodextrin, or hydroxypropyl-beta-cyclodextrin), fillers, monosaccharides, disaccharides, and other carbohydrates (such as glucose, mannose, or dextrins), proteins (such as serum albumin, gelatin, or immunoglobulins), coloring, flavoring and diluting agents, emulsifying agents, hydrophilic polymers (such as polyvinylpyrrolidone), low molecular weight polypeptides, salt-forming counterions (such as sodium), preservatives (such as benzalkonium chloride, benzoic acid, salicylic acid, thimerosal, phenethyl alcohol, methylparaben, propylparaben, chlorhexidine, sorbic acid, or hydrogen peroxide), solvents (such as glycerin, propylene glycol, or polyethylene glycol), sugar alcohols (such as mannitol or sorbitol), suspending agents, surfactants or wetting agents (such as pluronics; PEG; sorbitan esters; polysorbates such as polysorbate 20 or polysorbate 80; triton; tromethamine; lecithin; cholesterol or tyloxapal), stability enhancing agents (such as sucrose or sorbitol), tonicity enhancing agents (such as alkali metal halides—e.g., sodium or potassium chloride—or mannitol sorbitol), delivery vehicles, diluents, excipients and/or pharmaceutical adjuvants (see, e.g., Remington's Pharmaceutical Sciences (18th Ed., A. R. Gennaro, ed., Mack Publishing Company 1990), and subsequent editions of the same, incorporated herein by reference for any purpose).

The optimal pharmaceutical composition will be determined by a skilled artisan depending upon, for example, the intended route of administration, delivery format, and desired dosage. Such compositions can influence the physical state, stability, rate of in vivo release, and rate of in vivo clearance of the binding protein.

The primary vehicle or carrier in a pharmaceutical composition can be either aqueous or non-aqueous in nature. For example, a suitable vehicle or carrier for injection can be water, physiological saline solution, or artificial cerebrospinal fluid, possibly supplemented with other materials common in compositions for parenteral administration. Neutral buffered saline or saline mixed with serum albumin are further exemplary vehicles. Other exemplary pharmaceutical compositions comprise Tris buffer of about pH 7.0-8.5, or acetate buffer of about pH 4.0-5.5, which can further include sorbitol or a suitable substitute. In one embodiment of the disclosure, binding protein compositions can be prepared for storage by mixing the selected composition having the desired degree of purity with optional formulation agents in the form of a lyophilized cake or an aqueous solution. Further, the binding protein can be formulated as a lyophilizate using appropriate excipients such as sucrose.

The pharmaceutical compositions of the disclosure can be selected for parenteral delivery or subcutaneous. Alternatively, the compositions can be selected for inhalation or for delivery through the digestive tract, such as orally. The preparation of such pharmaceutically acceptable compositions is within the skill of the art.

The formulation components are present in concentrations that are acceptable to the site of administration. For example, buffers are used to maintain the composition at physiological pH or at a slightly lower pH, typically within a pH range of from about 5 to about 8.

When parenteral administration is contemplated, the therapeutic compositions for use can be in the form of a pyrogen-free, parenterally acceptable, aqueous solution comprising the desired binding protein in a pharmaceutically acceptable vehicle. A particularly suitable vehicle for parenteral injection is sterile distilled water in which a binding protein is formulated as a sterile, isotonic solution, properly preserved. Yet another preparation can involve the formulation of the desired molecule with an agent, such as injectable microspheres, bio-erodible particles, polymeric compounds (such as polylactic acid or polyglycolic acid), beads, or liposomes, that provides for the controlled or sustained release of the product which can then be delivered via a depot injection. Hyaluronic acid can also be used, and this can have the effect of promoting sustained duration in the circulation. Other suitable means for the introduction of the desired molecule include implantable drug delivery devices.

In one embodiment, a pharmaceutical composition can be formulated for inhalation. For example, a binding protein can be formulated as a dry powder for inhalation. Binding protein inhalation solutions can also be formulated with a propellant for aerosol delivery. In yet another embodiment, solutions can be nebulized.

It is also contemplated that certain formulations can be administered orally. In one embodiment of the disclosure, binding proteins that are administered in this fashion can be formulated with or without those carriers customarily used in the compounding of solid dosage forms such as tablets and capsules. For example, a capsule can be designed to release the active portion of the formulation at the point in the gastrointestinal tract where bioavailability is maximized and pre-systemic degradation is minimized. Additional agents can be included to facilitate absorption of the binding protein. Diluents, flavorings, low melting point waxes, vegetable oils, lubricants, suspending agents, tablet disintegrating agents, and binders can also be employed.

Another pharmaceutical composition can involve an effective quantity of binding proteins in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions of the disclosure will be evident to those skilled in the art, including formulations involving binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. Additional examples of sustained-release preparations include semipermeable polymer matrices in the form of shaped articles, e.g. films, or microcapsules. Sustained release matrices can include polyesters, hydrogels, polylactides, copolymers of L-glutamic acid and gamma ethyl-L-glutamate, poly(2-hydroxyethyl-methacrylate), ethylene vinyl acetate, or poly-D(−)-3-hydroxybutyric acid. Sustained-release compositions can also include liposomes, which can be prepared by any of several methods known in the art.

Pharmaceutical compositions to be used for in vivo administration typically must be sterile. This can be accomplished by filtration through sterile filtration membranes. Where the composition is lyophilized, sterilization using this method can be conducted either prior to, or following, lyophilization and reconstitution. The composition for parenteral administration can be stored in lyophilized form or in a solution. In addition, parenteral compositions generally are placed into a container having a sterile access port, for example, an intravenous solution bag or vial having a stopper pierceable by a hypodermic injection needle.

Once the pharmaceutical composition has been formulated, it can be stored in sterile vials as a solution, suspension, gel, emulsion, solid, or as a dehydrated or lyophilized powder. Such formulations can be stored either in a ready-to-use form or in a form (e.g., lyophilized) requiring reconstitution prior to administration.

The disclosure also encompasses kits for producing a single-dose administration unit. The kits can each contain both a first container having a dried protein and a second container having an aqueous formulation. Also included within the scope of this disclosure are kits containing single and multi-chambered pre-filled syringes (e.g., liquid syringes and lyosyringes).

The effective amount of a binding protein pharmaceutical composition to be employed therapeutically will depend, for example, upon the therapeutic context and objectives. One skilled in the art will appreciate that the appropriate dosage levels for treatment will thus vary depending, in part, upon the molecule delivered, the indication for which the binding protein is being used, the route of administration, and the size (body weight, body surface, or organ size) and condition (the age and general health) of the patient. Accordingly, the clinician can titer the dosage and modify the route of administration to obtain the optimal therapeutic effect.

Dosing frequency will depend upon the pharmacokinetic parameters of the binding protein in the formulation being used. Typically, a clinician will administer the composition until a dosage is reached that achieves the desired effect. The composition can therefore be administered as a single dose, as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages can be ascertained through use of appropriate dose-response data.

The route of administration of the pharmaceutical composition is in accord with known methods, e.g., orally; through injection by intravenous, intraperitoneal, intracerebral (intraparenchymal), intracerebroventricular, intramuscular, intraocular, intraarterial, intraportal, or intralesional routes; by sustained release systems; or by implantation devices. Where desired, the compositions can be administered by bolus injection or continuously by infusion, or by implantation device.

The composition can also be administered locally via implantation of a membrane, sponge, or other appropriate material onto which the desired molecule has been absorbed or encapsulated. Where an implantation device is used, the device can be implanted into any suitable tissue or organ, and delivery of the desired molecule can be via diffusion, timed-release bolus, or continuous administration.

The pharmaceutical compositions can be used to prevent and/or treat HIV infection. The pharmaceutical compositions can be used as a standalone therapy or in combination with standard anti-retroviral therapy.

The disclosure also relates to a kit comprising a binding protein and other reagents useful for detecting target antigen levels in biological samples. Such reagents can include a detectable label, blocking serum, positive and negative control samples, and detection reagents. In some embodiments, the kit comprises a composition comprising any binding protein, polynucleotide, vector, vector system, and/or host cell described herein. In some embodiments, the kit comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing a condition (e.g., HIV infection) and may have a sterile access port (for example the container may be an intravenous solution bag or a vial having a stopper pierceable by a hypodermic injection needle). In some embodiments, the label or package insert indicates that the composition is used for preventing, diagnosing, and/or treating the condition of choice. Alternatively, or additionally, the article of manufacture or kit may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

Methods and Uses for Binding Proteins in Treating and/or Preventing HIV/AIDS

Certain aspects of the present disclosure relate to methods of preventing HIV infection in a patient, treating HIV infection in a patient, preventing AIDS in a patient, and treating AIDS in a patient, using any of the binding proteins or pharmaceutical compositions disclosed herein. Any of the binding proteins or pharmaceutical compositions disclosed herein may find use in a method of the present disclosure, e.g., methods for preventing HIV infection in a patient, treating HIV infection in a patient, preventing AIDS in a patient, and treating AIDS in a patient.

Figure 19:
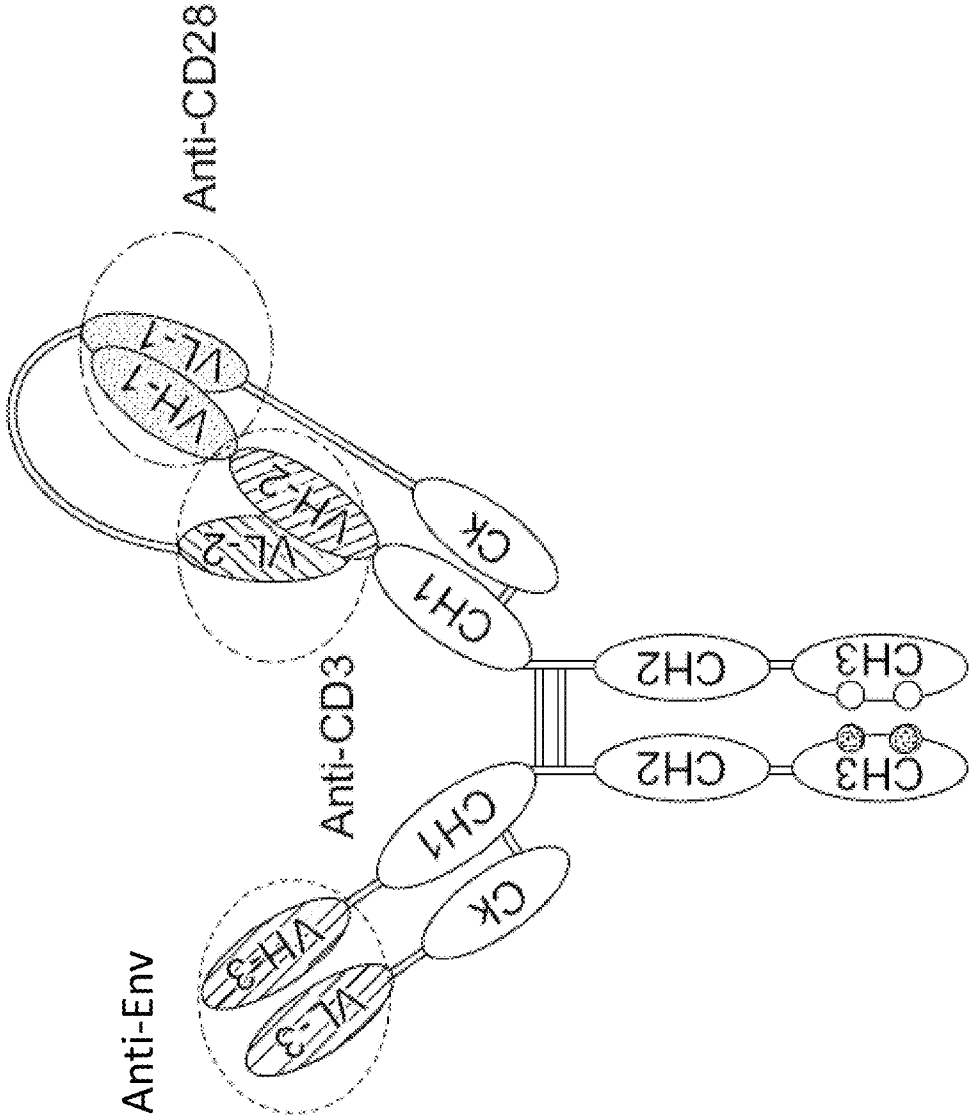
FIG. 19 provides a schematic representation of a trispecific binding protein comprising four polypeptide chains that form three antigen binding sites that binds three target proteins: CD28, CD3, and HIV Env. A first pair of polypeptides possess dual variable domains having a cross-over orientation (VH1-VH2 and VL2-VL1) forming two antigen binding sites (VH1 and VL1; VH2 and VL2) that recognize CD28 and CD3, resepectively, and a second pair of polypeptides possess a single variable domain (VH3 and VL3) forming a single antigen binding site that recognizes HIV Env. The trispecific binding protein shown in FIG. 19 uses a constant region with a "knobs-into-holes" mutation, where the knob is on the second pair of polypeptides with a single variable domain
Figure 20:
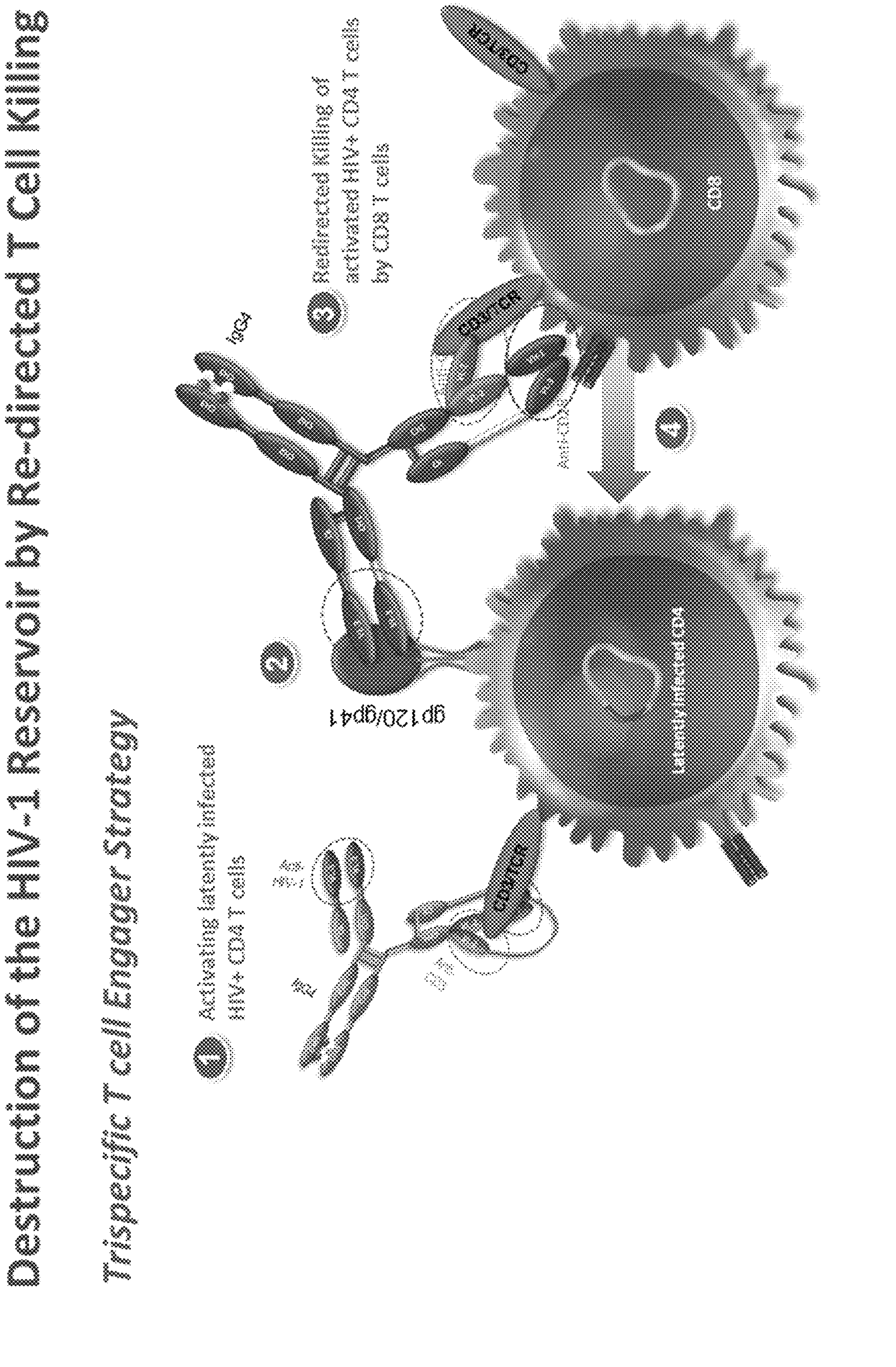
FIG. 20 shows a schematic representation of a trispecific T cell Engager (TCE) strategy for using the anti-HIV trispecific binding protein shown in FIG. 19 to target and eliminate the HIV reservoir.

FIG. 19 illustrates an exemplary and non-limiting format for a trispecific binding protein that may be employed in the methods and uses described herein. As shown in FIG. 20, a proposed mechanism by which the binding protein shown in FIG. 19 may result in elimination of the HIV reservoir cells in a patient involves: (1) activation of latently infected CD4+ T cells via the anti-CD28 and anti-CD3 arms of the trispecific binding protein; (2) recruitment of CD8+ T cells to activated, latently infected CD4+ T cells via anti-Env and anti-CD3 arms; (3) activation of engaged CD8+ T cells via the anti-CD28 and anti-CD3 arms; and (4) killing of latently infected CD4+ T cells through a Perforin/Granzyme mechanism. Advantageously, this mechanism is thought to activate and subsequently kill HIV-1 reservoir cells, providing a novel strategy for attacking the HIV-1 reservoir in a patient.

In some embodiments, the methods of the present disclosure comprise administering to the patient a therapeutically effective amount of at least one of the binding proteins or pharmaceutical compositions described herein.

In some embodiments, the at least one binding protein is administered in combination with an anti-retroviral therapy (e.g., an anti-HIV therapy). In some embodiments, the at least one binding protein is administered before the anti-retroviral therapy. In some embodiments, the at least one binding protein is administered concurrently with the anti-retroviral therapy. In some embodiments, the at least one binding protein is administered after the anti-retroviral therapy. In some embodiments, the at least one binding protein is co-administered with any standard anti-retroviral therapy known in the art.

In some embodiments, administration of the at least one binding protein or pharmaceutical composition results in elimination of one or more latently and/or chronically HIV-infected cells in the patient. In some embodiments, administration of the at least one binding protein results in neutralization of one or more HIV virions and results in elimination of one or more latently and/or chronically HIV-infected cells in the patient. In some embodiments, the patient is a human.

TABLE 4A

Trispecific binding protein polypeptide sequences.

| Molecule | Polypeptide Number (acc. to formula) | SEQ ID NO | Sequence |
|---|---|---|---|
| Trispecific 1 VRC07_523/ CD28sup x CD3mid IgG1 LALA/P329A | 1 | 362 | DIVMTQTPLSLSVTPGQPASISCKSSQSLVHNNANTYLSWYLQKPGQSPQSLIYKVSNRFSGVPDRFSGSGSGTDFTLKISR<br>VEAEDVGVYYCGQGTQYPFTFGSGTKVEIKGQPKAAPDIQMTQSPSSLSASVGDRVTITCQASQNIYVWLNWYQQKPGK<br>APKLLIYKASNLHTGVPSRFSGSGSGTDFTLTISSLQPEDIATYYCQQGQTYPYTFGQGTKLEIKTKGPSRTVAAPSVFIFPPS<br>DEQLKSGTASVVCLLNNFYPREAKVQWKVDNALQSGNSQESVTEQDSKDSTYSLSSTLTLSKADYEKHKVYACEVTHQG<br>LSSPVTKSFNRGEC |
| | 2 | 363 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSSQVQLVESGGGVVQPGRSLRLSCAASGFTFTKAWMH<br>WVRQAPGKQLEWVAQIKDKSNSYATYYADSVKGRFTISRDDSKNTLYLQMNSLRAEDTAVYYCRGVYYALSPFDYWG<br>QGTLVTVSSRTASTKGPSVFPLAPSSKSTSGGTAALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPEAAGGPSVFLFPPKPKDTLMISRTPEVTCVVVDVSH<br>EDPEVKFNWYVDGVEVHNAKTKPREEQYNSTYRVVSVLTVLHQDWLNGKEYKCKVSNKALAAPIEKTISKAKGQPREP<br>QVCTLPPSRDELTKNQVSLSCAVKGFYPSDIAVEWESNGQPENNYKTTPPVLDSDGSFFLVSKLTVDKSRWQQGNVFSCS<br>VMHEALHNHYTQKSLSLSPG |
| | 3 | 364 | QVRLSQSGGQMKKPGDSMRISCRASGYEFINCPINWIRLAPGKRPEWMGWMKPRHGAVSYARQLQGRVTMTRDMYSET<br>AFLELRSLTSDDTAVYFCTRGKYCTARDYYNWDEERWGQGTPVTVSSASTKGPSVFPLAPSSKSTSGGTAALGCLVKDYF<br>PEPVTVSWNSGALTSGVHTFPAVLQSSGLYSLSSVVTVPSSSLGTQTYICNVNHKPSNTKVDKKVEPKSCDKTHTCPPCPA<br>PEAAGGPSVFLFPPKPKDTLMISRTPEVTCVVVDVSHEDPEVKFNWYVDGVEVHNAKTKPREEQYNSTYRVVSVLTVLH<br>QDWLNGKEYKCKVSNKALAAPIEKTISKAKGQPREPQVYTLPPCRDELTKNQVSLWCLVKGFYPSDIAVEWESNGQPEN<br>NYKTTPPVLDSDGSFFLYSKLTVDKSRWQQGNVFSCSVMHEALHNHYTQKSLSLSPG |
| | 4 | 365 | SLTQSPGTLSLSPGETAIISCRTSQYGSLAWYQQRPGQAPRLVIYSGSTRAAGIPDRFSGSRWGPDYNLTISNLESGDFGVYY<br>CQQYEFFGQGTKVQVDIKRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| Trispecific 2 VRC07_523/ CD28sup x CD3mid IgG1 NNAS | 1 | 366 | DIVMTQTPLSLSVTPGQPASISCKSSQSLVHNNANTYLSWYLQKPGQSPQSLIYKVSNRFSGVPDRFSGSGSGTDFTLKISR<br>VEAEDVGVYYCGQGTQYPFTFGSGTKVEIKGQPKAAPDIQMTQSPSSLSASVGDRVTITCQASQNIYVWLNWYQQKPGK<br>APKLLIYKASNLHTGVPSRFSGSGSGTDFTLTISSLQPEDIATYYCQQGQTYPYTFGQGTKLEIKTKGPSRTVAAPSVFIFPPS<br>DEQLKSGTASVVCLLNNFYPREAKVQWKVDNALQSGNSQESVTEQDSKDSTYSLSSTLTLSKADYEKHKVYACEVTHQG<br>LSSPVTKSFNRGEC |
| | 2 | 367 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSSQVQLVESGGGVVQPGRSLRLSCAASGFTFTKAWMH<br>WVRQAPGKQLEWVAQIKDKSNSYATYYADSVKGRFTISRDDSKNTLYLQMNSLRAEDTAVYYCRGVYYALSPFDYWG<br>QGTLVTVSSRTASTKGPSVFPLAPSSKSTSGGTAALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLGGPSVFLFPPKPKDTLMISRTPEVTCVVVDVSHE<br>DPEVKFNWYVDGVEVHNAKTKPREEQYNNASRVVSVLTVLHQDWLNGKEYKCKVSNKALPAPIEKTISKAKGQPREPQ<br>VCTLPPSRDELTKNQVSLSCAVKGFYPSDIAVEWESNGQPENNYKTTPPVLDSDGSFFLVSKLTVDKSRWQQGNVFSCSV<br>MHEALHNHYTQKSLSLSPG |
| | 3 | 368 | QVRLSQSGGQMKKPGDSMRISCRASGYEFINCPINWIRLAPGKRPEWMGWMKPRHGAVSYARQLQGRVTMTRDMYSET<br>AFLELRSLTSDDTAVYFCTRGKYCTARDYYNWDEERWGQGTPVTVSSASTKGPSVFPLAPSSKSTSGGTAALGCLVKDYF<br>PEPVTVSWNSGALTSGVHTFPAVLQSSGLYSLSSVVTVPSSSLGTQTYICNVNHKPSNTKVDKKVEPKSCDKTHTCPPCPA |

TABLE 4A-continued

| Trispecific binding protein polypeptide sequences. | | | |
|---|---|---|---|
| Molecule | Polypeptide Number (acc. to formula) | SEQ ID NO | Sequence |
| | | | PELLGGPSVFLFPPKPKDTLMISRTPEVTCVVVDVSHEDPEVKFNWYVDGVEVHNAKTKPREEQYNNASRVVSVLTVLHQ<br>DWLNGKEYKCKVSNKALPAPIEKTISKAKGQPREPQVYTLPPCRDELTKNQVSLWCLVKGFYPSDIAVEWESNGQPENNY<br>KTTPPVLDSDGSFFLYSKLTVDKSRWQQGNVFSCSVMHEALHNHYTQKSLSLSPG |
| | 4 | 369 | SLTQSPGTLSLSPGETAIISCRTSQYGSLAWYQQRPGQAPRLVIYSGSTRAAGIPDRFSGSRWGPDYNLTISNLESGDFGVYY<br>CQQYEFFGQGTKVQVDIKRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| Trispecific 3 VRC07_523/ CD28sup x CD3mid IgG4 FALA/409K | 1 | 370 | DIVMTQTPLSLSVTPGQPASISCKSSQSLVHNNANTYLSWYLQKPGQSPQSLIYKVSNRFSGVPDRFSGSGSGTDFTLKISR<br>VEAEDVGVYYCGQGTQYPFTFGSGTKVEIKGQPKAAPDIQMTQSPSSLSASVGDRVTITCQASQNIYVWLNWYQQKPGK<br>APKLLIYKASNLHTGVPSRFSGSGSGTDFTLTISSLQPEDIATYYCQQGQTYPYTFGQGTKLEIKTKGPSRTVAAPSVFIFPPS<br>DEQLKSGTASVVCLLNNFYPREAKVQWKVDNALQSGNSQESVTEQDSKDSTYSLSSTLTLSKADYEKHKVYACEVTHQG<br>LSSPVTKSFNRGEC |
| | 2 | 371 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSSQVQLVESGGGVVQPGRSLRLSCAASGFTFTKAWMH<br>WVRQAPGKQLEWVAQIKDKSNSYATYYADSVKGRFTISRDDSKNTLYLQMNSLRAEDTAVYYCRGVYYALSPFDYWG<br>QGTLVTVSSRTASTKGPSVFPLAPCSRSTSESTAALGCLVKDYFPEPVTVSWNSGALTSGVHTFPAVLQSSGLYSLSSVVTV<br>PSSSLGTKTYTCNVDHKPSNTKVDKRVESKYGPPCPPCPAPEAAGGPSVFLFPPKPKDTLMISRTPEVTCVVVDVSQEDPE<br>VQFNWYVDGVEVHNAKTKPREEQFNSTYRVVSVLTVLHQDWLNGKEYKCKVSNKGLPSSIEKTISKAKGQPREPQVCTL<br>PPSQEEMTKNQVSLSCAVKGFYPSDIAVEWESNGQPENNYKTTPPVLDSDGSFFLVSKLTVDKSRWQEGNVFSCSVMHEA<br>LHNHYTQKSLSLSLG |
| | 3 | 372 | QVRLSQSGGQMKKPGDSMRISCRASGYEFINCPINWIRLAPGKRPEWMGWMKPRHGAVSYARQLQGRVTMTRDMYSET<br>AFLELRSLTSDDTAVYFCTRGKYCTARDYYNWDFEHWGQGTPVTVSSASTKGPSVFPLAPCSRSTSESTAALGCLVKDYF<br>PEPVTVSWNSGALTSGVHTFPAVLQSSGLYSLSSVVTVPSSSLGTKTYTCNVDHKPSNTKVDKRVESKYGPPCPPCPAPEA<br>AGGPSVFLFPPKPKDTLMISRTPEVTCVVVDVSQEDPEVQFNWYVDGVEVHNAKTKPREEQFNSTYRVVSVLTVLHQDW<br>LNGKEYKCKVSNKGLPSSIEKTISKAKGQPREPQVYTLPPCQEEMTKNQVSLWCLVKGFYPSDIAVEWESNGQPENNYKT<br>TPPVLDSDGSFFLYSKLTVDKSRWQEGNVFSCSVMHEALHNHYTQKSLSLSLG |
| | 4 | 373 | SLTQSPGTLSLSPGETAIISCRTSQYGSLAWYQQRPGQAPRLVIYSGSTRAAGIPDRFSGSRWGPDYNLTISNLESGDFGVYY<br>CQQYEFFGQGTKVQVDIKRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| Trispecific 4 VRC07_523/ CD28sup x CD3mid_QQ IgG4 FALA/409K | 1 | 374 | DIVMTQTPLSLSVTPGQPASISCKSSQSLVHQNAQTYLSWYLQKPGQSPQSLIYKVSNRFSGVPDRFSGSGSGTDFTLKISR<br>VEAEDVGVYYCGQGTQYPFTFGSGTKVEIKGQPKAAPDIQMTQSPSSLSASVGDRVTITCQASQNIYVWLNWYQQKPGK<br>APKLLIYKASNLHTGVPSRFSGSGSGTDFTLTISSLQPEDIATYYCQQGQTYPYTFGQGTKLEIKTKGPSRTVAAPSVFIFPPS<br>DEQLKSGTASVVCLLNNFYPREAKVQWKVDNALQSGNSQESVTEQDSKDSTYSLSSTLTLSKADYEKHKVYACEVTHQG<br>LSSPVTKSFNRGEC |
| | 2 | 375 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSSQVQLVESGGGVVQPGRSLRLSCAASGFTFTKAWMH<br>WVRQAPGKQLEWVAQIKDKSNSYATYYADSVKGRFTISRDDSKNTLYLQMNSLRAEDTAVYYCRGVYYALSPFDYWG<br>QGTLVTVSSRTASTKGPSVFPLAPCSRSTSESTAALGCLVKDYFPEPVTVSWNSGALTSGVHTFPAVLQSSGLYSLSSVVTV<br>PSSSLGTKTYTCNVDHKPSNTKVDKRVESKYGPPCPPCPAPEAAGGPSVFLFPPKPKDTLMISRTPEVTCVVVDVSQEDPE |

TABLE 4A-continued

Trispecific binding protein polypeptide sequences.

| Molecule | Polypeptide Number (acc. to formula) | SEQ ID NO | Sequence |
|---|---|---|---|
| | | | VQFNWYVDGVEVHNAKTKPREEQFNSTYRVVSVLTVLHQDWLNGKEYKCKVSNKGLPSSIEKTISKAKGQPREPQVCTL<br>PPSQEEMTKNQVSLSCAVKGFYPSDIAVEWESNGQPENNYKTTPPVLDSDGSFFLVSKLTVDKSRWQEGNVFSCSVMHEA<br>LHNHYTQKSLSLSLG |
| | 3 | 376 | QVRLSQSGGQMKKPGDSMRISCRASGYEFINCPINWIRLAPGKRPEWMGWMKPRHGAVSYARQLQGRVTMTRDMYSET<br>AFLELRSLTSDDTAVYFCTRGKYCTARDYYNWDFEHWGQGTPVTVSSASTKGPSVFPLAPCSRSTSESTAALGCLVKDYF<br>PEPVTVSWNSGALTSGVHTFPAVLQSSGLYSLSSVVTVPSSSLGTKTYTCNVDHKPSNTKVDKRVESKYGPPCPPCPAPEA<br>AGGPSVFLFPPKPKDTLMISRTPEVTCVVVDVSQEDPEVQFNWYVDGVEVHNAKTKPREEQFNSTYRVVSVLTVLHQDW<br>LNGKEYKCKVSNKGLPSSIEKTISKAKGQPREPQVYTLPPCQEEMTKNQVSLWCLVKGFYPSDIAVEWESNGQPENNYKT<br>TPPVLDSDGSFFLYSKLTVDKSRWQEGNVFSCSVMHEALHNHYTQKSLSLSLG |
| | 4 | 377 | SLTQSPGTLSLSPGETAIISCRTSQYGSLAWYQQRPGQAPRLVIYSGSTRAAGIPDRFSGSRWGPDYNLTISNLESGDFGVYY<br>CQQYEFFGQGTKVQVDIKRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| Trispecific 6<br>VRC07_523/<br>CD28sup x<br>CD3mid_QQ<br>IgG4<br>FALA/409K_<br>DKTHT linker | 1 | 378 | DIVMTQTPLSLSVTPGQPASISCKSSQSLVHQNAQTYLSWYLQKPGQSPQSLIYKVSNRFSGVPDRFSGSGSGTDFTLKISR<br>VEAEDVGVYYCGQGTQYPFTFGSGTKVEIKDKTHTDIQMTQSPSSLSASVGDRVTITCQASQNIYVWLNWYQQKPGKAP<br>KLLIYKASNLHTGVPSRFSGSGSGTDFTLTISSLQPEDIATYYCQQGQTYPYTFGQGTKLEIKDKTHTRTVAAPSVFIFPPSD<br>EQLKSGTASVVCLLNNFYPREAKVQWKVDNALQSGNSQESVTEQDSKDSTYSLSSTLTLSKADYEKHKVYACEVTHQGL<br>SSPVTKSFNRGEC |
| | 2 | 379 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSSQVQLVESGGGVVQPGRSLRLSCAASGFTFTKAWMH<br>WVRQAPGKQLEWVAQIKDKSNSYATYYADSVKGRFTISRDDSKNTLYLQMNSLRAEDTAVYYCRGVYYALSPFDYWG<br>QGTLVTVSSRTASTKGPSVFPLAPCSRSTSESTAALGCLVKDYFPEPVTVSWNSGALTSGVHTFPAVLQSSGLYSLSSVVTV<br>PSSSLGTKTYTCNVDHKPSNTKVDKRVESKYGPPCPPCPAPEAAGGPSVFLFPPKPKDTLMISRTPEVTCVVVDVSQEDPE<br>VQFNWYVDGVEVHNAKTKPREEQFNSTYRVVSVLTVLHQDWLNGKEYKCKVSNKGLPSSIEKTISKAKGQPREPQVCTL<br>PPSQEEMTKNQVSLSCAVKGFYPSDIAVEWESNGQPENNYKTTPPVLDSDGSFFLVSKLTVDKSRWQEGNVFSCSVMHEA<br>LHNHYTQKSLSLSLG |
| | 3 | 380 | QVRLSQSGGQMKKPGDSMRISCRASGYEFINCPINWIRLAPGKRPEWMGWMKPRHGAVSYARQLQGRVTMTRDMYSET<br>AFLELRSLTSDDTAVYFCTRGKYCTARDYYNWDFEHWGQGTPVTVSSASTKGPSVFPLAPCSRSTSESTAALGCLVKDYF<br>PEPVTVSWNSGALTSGVHTFPAVLQSSGLYSLSSVVTVPSSSLGTKTYTCNVDHKPSNTKVDKRVESKYGPPCPPCPAPEA<br>AGGPSVFLFPPKPKDTLMISRTPEVTCVVVDVSQEDPEVQFNWYVDGVEVHNAKTKPREEQFNSTYRVVSVLTVLHQDW<br>LNGKEYKCKVSNKGLPSSIEKTISKAKGQPREPQVYTLPPCQEEMTKNQVSLWCLVKGFYPSDIAVEWESNGQPENNYKT<br>TPPVLDSDGSFFLYSKLTVDKSRWQEGNVFSCSVMHEALHNHYTQKSLSLSLG |
| | 4 | 381 | SLTQSPGTLSLSPGETAIISCRTSQYGSLAWYQQRPGQAPRLVIYSGSTRAAGIPDRFSGSRWGPDYNLTISNLESGDFGVYY<br>CQQYEFFGQGTKVQVDIKRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| Trispecific 8<br>VRC07_523/<br>CD28sup x | 1 | 382 | DIVMTQTPLSLSVTPGQPASISCKSSQSLVHQNAQTYLSWYLQKPGQSPQSLIYKVSNRFSGVPDRFSGSGSGTDFTLKISR<br>VEAEDVGVYYCGQGTQYPFTFGSGTKVEIKDKTHTDIQMTQSPSSLSASVGDRVTITCQASQNIYVWLNWYQQKPGKAP<br>KLLIYKASNLHTGVPSRFSGSGSGTDFTLTISSLQPEDIATYYCQQGQTYPYTFGQGTKLEIKDKTHTRTVAAPSVFIFPPSD |

TABLE 4A-continued

Trispecific binding protein polypeptide sequences.

| Molecule | Polypeptide Number (acc. to formula) | SEQ ID NO | Sequence |
| --- | --- | --- | --- |
| CD3mid_QQ IgG1_NNAS/ 409K_DKTHT linker | | | EQLKSGTASVVCLLNNFYPREAKVQWKVDNALQSGNSQESVTEQDSKDSTYSLSSTLTLSKADYEKHKVYACEVTHQGL SSPVTKSFNRGEC |
| | 2 | 383 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSDKTHTQVQLVESGGGVVQPGRSLRLSCAASGFTFTKA WMHWVRQAPGKQLEWVAQIKDKSNSYATYYADSVKGRFTISRDDSKNTLYLQMNSLRAEDTAVYYCRGVYYALSPFD YWGQGTLVTVSSDKTHTASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSCDKTHTCPPCPAPELLGGPSVFLFPPKPKDTLMISRTPEVTCV VVDVSHEDPEVKFNWYVDGVEVHNAKTKPREEQYNNASRVVSVLTVLHQDWLNGKEYKCKVSNKALPAPIEKTISKAK GQPREPQVCTLPPSRDELTKNQVSLSCAVKGFYPSDIAVEWESNGQPENNYKTTPPVLDSDGSFFLVSKLTVDKSRWQQG NVFSCSVMHEALHNHYTQKSLSLSPG |
| | 3 | 384 | QVRLSQSGGQMKKPGDSMRISCRASGYEFINCPINWIRLAPGKRPEWMGWMKPRHGAVSYARQLQGRVTMTRDMYSET AFLELRSLTSDDTAVYFCTRGKYCTARDYYNWDFERWGQGTPVTVSSASTKGPSVFPLAPSSKSTSGGTAALGCLVKDYF PEPVTVSWNSGALTSGVHTFPAVLQSSGLYSLSSVVTVPSSSLGTQTYICNVNHKPSNTKVDKKVEPKSCDKTHTCPPCPA PELLGGPSVFLFPPKPKDTLMISRTPEVTCVVVDVSHEDPEVKFNWYVDGVEVHNAKTKPREEQYNNASRVVSVLTVLHQ DWLNGKEYKCKVSNKALPAPIEKTISKAKGQPREPQVYTLPPCRDELTKNQVSLWCLVKGFYPSDIAVEWESNGQPENNY KTTPPVLDSDGSFFLYSKLTVDKSRWQQGNVFSCSVMHEALHNHYTQKSLSLSPG |
| | 4 | 385 | SLTQSPGTLSLSPGETAIISCRTSQYGSLAWYQQRPGQAPRLVIYSGSTRAAGIPDRFSGSRWGPDYNLTISNLESGDFGVYY CQQYEFFGQGTKVQVDIKRTVAAPSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| Trispecific 9 VRC07_523_ FR3-03/ CD28sup x CD3mid_ ENLQ IgG4 FALA/409K_ DKTHT linker | 1 | 386 | DIVMTQTPLSLSVTPGQPASISCKSSQSLVHENLQTYLSWYLQKPGQSPQSLIYKVSNRFSGVPDRFSGSGSGTDFTLKISRV EAEDVGVYYCGQGTQYPFTFGSGTKVEIKDKTHTDIQMTQSPSSLSASVGDRVTITCQASQNIYVWLNWYQQKPGKAPK LLIYKASNLHTGVPSRFSGSGSGTDFTLTISSLQPEDIATYYCQQGQTYPYTFGQGTKLEIKDKTHTRTVAAPSVFIFPPSDE QLKSGTASVVCLLNNFYPREAKVQWKVDNALQSGNSQESVTEQDSKDSTYSLSSTLTLSKADYEKHKVYACEVTHQGLS SPVTKSFNRGEC |
| | 2 | 387 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSSQVQLVESGGGVVQPGRSLRLSCAASGFTFTKAWMH WVRQAPGKQLEWVAQIKDKSNSYATYYADSVKGRFTISRDDSKNTLYLQMNSLRAEDTAVYYCRGVYYALSPFDYWG QGTLVTVSSRTASTKGPSVFPLAPCSRSTSESTAALGCLVKDYFPEPVTVSWNSGALTSGVHTFPAVLQSSGLYSLSSVVTV PSSSLGTKTYTCNVDHKPSNTKVDKRVESKYGPPCPPCPAPEAAGGPSVFLFPPKPKDTLMISRTPEVTCVVVDVSQEDPE VQFNWYVDGVEVHNAKTKPREEQFNSTYRVVSVLTVLHQDWLNGKEYKCKVSNKGLPSSIEKTISKAKGQPREPQVCTL PPSQEEMTKNQVSLSCAVKGFYPSDIAVEWESNGQPENNYKTTPPVLDSDGSFFLVSKLTVDKSRWQEGNVFSCSVMHEA LHNHYTQKSLSLSLG |
| | 3 | 388 | QVRLSQSGGQMKKPGDSMRISCRASGYEFINCPINWIRLAPGKRPEWMGWMKPRHGAVSYARQLQGRVTMTRQLSQDP DDPDWGTAFLELRSLTSDDTAVYFCTRGKYCTARDYYNWDEEHWGQGTPVTVSSASTKGPSVFPLAPCSRSTSESTAALG CLVKDYFPEPVTVSWNSGALTSGVHTFPAVLQSSGLYSLSSVVTVPSSSLGTKTYTCNVDHKPSNTKVDKRVESKYGPPCP |

TABLE 4A-continued

Trispecific binding protein polypeptide sequences.

| Molecule | Polypeptide Number (acc. to formula) | SEQ ID NO | Sequence |
|---|---|---|---|
| | | | PCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 389 | SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| Trispecific 10 VRC07_523_ FR3-03/ CD28sup x CD3mid_ ENLF IgG4 FALA/409K_ DKTHT linker | 1 | 390 | DIVMTQTPLSLSVTPGQPASISCKSSQSLVHENLFTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 391 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 392 | QVRLSQSGGQMKKPGDSMRISCRASGYEFINCPINWIRLAPGKRPEWMGWMKPRHGAVSYARQLQGRVTMTRQLSQDPDDPDWGTAFLELRSLTSDDTAVYFCTRGKYCTARDYYNWDEEHWGQGTPVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 393 | SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| Trispecific 11 VRC07_523_ FR3-03/ CD28sup x CD3mid_ ENLQ IgG1_NNAS_ DKTHT linker | 1 | 394 | DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 4A-continued

| Trispecific binding protein polypeptide sequences. | | | |
|---|---|---|---|
| Molecule | Polypeptide Number (acc. to formula) | SEQ ID NO | Sequence |
| | 2 | 395 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPCPAPELLGGPSVFLFPPKPKDTLMISRTPEVTCV<br>VVDVSHEDPEVKFNWYVDGVEVHNAKTKPREEQYNNASRVVSVLTVLHQDWLNGKEYKCKVSNKALPAPlEKTISKAK<br>GQPREPQVCTLPPSRDELTKNQVSLSCAVKGFYPSDIAVEWESNGQPENNYKTTPPVLDSDGSFFLVSKLTVDKSRWQQG<br>NVFSCSVMHEALHNHYTQKSLSLSPG |
| | 3 | 396 | QVRLSQSGGQMKKPGDSMRISCRASGYEFINCPINWIRLAPGKRPEWMGWMKPRHGAVSYARQLQGRVTMTRQLSQDP<br>DDPDWGTAFLELRSLTSDDTAVYFCTRGKYCTARDYYNWDEEHWGQGTPVTVSSASTKGPSVFPLAPSSKSTSGGTAAL<br>GCLVKDYFPEPVTVSWNSGALTSGVHTFPAVLQSSGLYSLSSVVTVPSSSLGTQTYICNVNHKPSNTKVDKKVEPKSCDKT<br>HTCPPCPAPELLGGPSVFLFPPKPKDTLMISRTPEVTCVVVDVSHEDPEVKFNWYVDGVEVHNAKTKPREEQYNNASRVV<br>SVLTVLHQDWLNGKEYKCKVSNKALPAPIEKTISKAKGQPREPQVYTLPPCRDELTKNQVSLWCLVKGFYPSDIAVEWES<br>NGQPENNYKTTPPVLDSDGSFFLYSKLTVDKSRWQQGNVFSCSVMHEALHNHYTQKSLSLSPG |
| | 4 | 397 | SLTQSPGTLSLSPGETAIISCRTSQYGSLAWYQQRPGQAPRLVIYSGSTRAAGIPDRFSGSRWGPDYNLTISNLESGDFGVYY<br>CQQYEFFGQGTKVQVDIKRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| Trispecific 12 VRC07_523_ FR3-03/ CD28sup x CD3mid_ ENLF IgG1_NNAS_ DKTHT linker | 1 | 398 | DIVMTQTPLSLSVTPGQPASISCKSSQSLVHENLFTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 399 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPCPAPELLGGPSVFLFPPKPKDTLMISRTPEVTCV<br>VVDVSHEDPEVKFNWYVDGVEVHNAKTKPREEQYNNASRVVSVLTVLHQDWLNGKEYKCKVSNKALPAPlEKTISKAK<br>GQPREPQVCTLPPSRDELTKNQVSLSCAVKGFYPSDIAVEWESNGQPENNYKTTPPVLDSDGSFFLVSKLTVDKSRWQQG<br>NVFSCSVMHEALHNHYTQKSLSLSPG |
| | 3 | 400 | QVRLSQSGGQMKKPGDSMRISCRASGYEFINCPINWIRLAPGKRPEWMGWMKPRHGAVSYARQLQGRVTMTRQLSQDP<br>DDPDWGTAFLELRSLTSDDTAVYFCTRGKYCTARDYYNWDEEHWGQGTPVTVSSASTKGPSVFPLAPSSKSTSGGTAAL<br>GCLVKDYFPEPVTVSWNSGALTSGVHTFPAVLQSSGLYSLSSVVTVPSSSLGTQTYICNVNHKPSNTKVDKKVEPKSCDKT<br>HTCPPCPAPELLGGPSVFLFPPKPKDTLMISRTPEVTCVVVDVSHEDPEVKFNWYVDGVEVHNAKTKPREEQYNNASRVV<br>SVLTVLHQDWLNGKEYKCKVSNKALPAPIEKTISKAKGQPREPQVYTLPPCRDELTKNQVSLWCLVKGFYPSDIAVEWES<br>NGQPENNYKTTPPVLDSDGSFFLYSKLTVDKSRWQQGNVFSCSVMHEALHNHYTQKSLSLSPG |
| | 4 | 401 | SLTQSPGTLSLSPGETAIISCRTSQYGSLAWYQQRPGQAPRLVIYSGSTRAAGIPDRFSGSRWGPDYNLTISNLESGDFGVYY |

TABLE 4A-continued

Trispecific binding protein polypeptide sequences.

| Molecule | Polypeptide Number (acc. to formula) | SEQ ID NO | Sequence |
|---|---|---|---|
| | | | CQQYEFFGQGTKVQVDIKRTVAAPSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| Trispecific 13 N6/CD28sup x CD3mid IgG4 | 1 | 402 | DIVMTQTPLSLSVTPGQPASISCKSSQSLVHNNANTYLSWYLQKPGQSPQSLIYKVSNRFSGVPDRFSGSGSGTDFTLKISR VEAEDVGVYYCGQGTQYPFTFGSGTKVEIKGQPKAAPDIQMTQSPSSLSASVGDRVTITCQASQNIYVWLNWYQQKPGK APKLLIYKASNLHTGVPSRFSGSGSGTDFTLTISSLQPEDIATYYCQQGQTYPYTFGQGTKLEIKTKGPSRTVAAPSVFIFPPS DEQLKSGTASVVCLLNNFYPREAKVQWKVDNALQSGNSQESVTEQDSKDSTYSLSSTLTLSKADYEKHKVYACEVTHQG LSSPVTKSFNRGEC |
| | 2 | 403 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSSQVQLVESGGGVVQPGRSLRLSCAASGFTFTKAWMH WVRQAPGKQLEWVAQIKDKSNSYATYYADSVKGRFTISRDDSKNTLYLQMNSLRAEDTAVYYCRGVYYALSPFDYWG QGTLVTVSSRTASTKGPSVFPLAPCSRSTSESTAALGCLVKDYFPEPVTVSWNSGALTSGVHTFPAVLQSSGLYSLSSVVTV PSSSLGTKTYTCNVDHKPSNTKVDKRVESKYGPPCPPCPAPPVAGPSVFLFPPKPKDTLMISRTPEVTCVVVDVSQEDPEV QFNWYVDGVEVHNAKTKPREEQFNSTYRVVSVLTVLHQDWLNGKEYKCKVSNKGLPSSIEKTISKAKGQPREPQVCTLP PSQEEMTKNQVSLSCAVKGFYPSDIAVEWESNGQPENNYKTTPPVLDSDGSFFLVSKLTVDKSRWQEGNVFSCSVMHEAL HNHYTQKSLSLSLG |
| | 3 | 404 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP VTVSWNSGALTSGVHTFPAVLQSSGLYSLSSVVTVPSSSLGTKTYTCNVDHKPSNTKVDKRVESKYGPPCPPCPAPPVAGP SVFLFPPKPKDTLMISRTPEVTCVVVDVSQEDPEVQFNWYVDGVEVHNAKTKPREEQFNSTYRVVSVLTVLHQDWLNGK EYKCKVSNKGLPSSIEKTISKAKGQPREPQVYTLPPCQEEMTKNQVSLWCLVKGFYPSDIAVEWESNGQPENNYKTTPPVL DSDGSFFLYSKLTVDKSRWQEGNVFSCSVMHEALHNHYTQKSLSLSLG |
| | 4 | 405 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 14 N6/CD28sup x CD3mid IgG4 | 1 | 406 | DIVMTQTPLSLSVTPGQPASISCKSSQSLVHNNANTYLSWYLQKPGQSPQSLIYKVSNRFSGVPDRFSGSGSGTDFTLKISR VEAEDVGVYYCGQGTQYPFTFGSGTKVEIKGQPKAAPDIQMTQSPSSLSASVGDRVTITCQASQNIYVWLNWYQQKPGK APKLLIYKASNLHTGVPSRFSGSGSGTDFTLTISSLQPEDIATYYCQQGQTYPYTFGQGTKLEIKTKGPSRTVAAPSVFIFPPS DEQLKSGTASVVCLLNNFYPREAKVQWKVDNALQSGNSQESVTEQDSKDSTYSLSSTLTLSKADYEKHKVYACEVTHQG LSSPVTKSFNRGEC |
| | 2 | 407 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSSQVQLVESGGGVVQPGRSLRLSCAASGFTFTKAWMH WVRQAPGKQLEWVAQIKDKSNSYATYYADSVKGRFTISRDDSKNTLYLQMNSLRAEDTAVYYCRGVYYALSPFDYWG QGTLVTVSSRTASTKGPSVFPLAPCSRSTSESTAALGCLVKDYFPEPVTVSWNSGALTSGVHTFPAVLQSSGLYSLSSVVTV PSSSLGTKTYTCNVDHKPSNTKVDKRVESKYGPPCPPCPAPEAAGGPSVFLFPPKPKDTLMISRTPEVTCVVVDVSQEDPE VQFNWYVDGVEVHNAKTKPREEQFNSTYRVVSVLTVLHQDWLNGKEYKCKVSNKGLPSSIEKTISKAKGQPREPQVCTL PPSQEEMTKNQVSLSCAVKGFYPSDIAVEWESNGQPENNYKTTPPVLDSDGSFFLVSKLTVDKSRWQEGNVFSCSVMHEA LHNHYTQKSLSLSLG |
| | 3 | 408 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP |

TABLE 4A-continued

Trispecific binding protein polypeptide sequences.

| Molecule | Polypeptide Number (acc. to formula) | SEQ ID NO | Sequence |
|---|---|---|---|
| | | | VTVSWNSGALTSGVHTFPAVLQSSGLYSLSSVVTVPSSSLGTKTYTCNVDHKPSNTKVDKRVESKYGPPCPPCPAPEAAG GPSVFLFPPKPKDTLMISRTPEVTCVVVDVSQEDPEVQFNWYVDGVEVHNAKTKPREEQFNSTYRVVSVLTVLHQDWLN GKEYKCKVSNKGLPSSIEKTISKAKGQPREPQVYTLPPCQEEMTKNQVSLWCLVKGFYPSDIAVEWESNGQPENNYKTTP PVLDSDGSFFLYSKLTVDKSRWQEGNVFSCSVMHEALHNHYTQKSLSLSLG |
| | 4 | 409 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 15 N6/CD28sup x CD3mid_QQ IgG4 FALA/409K | 1 | 410 | DIVMTQTPLSLSVTPGQPASISCKSSQSLVHQNAQTYLSWYLQKPGQSPQSLIYKVSNRFSGVPDRFSGSGSGTDFTLKISR VEAEDVGVYYCGQGTQYPFTFGSGTKVEIKGQPKAAPDIQMTQSPSSLSASVGDRVTITCQASQNIYVWLNWYQQKPGK APKLLIYKASNLHTGVPSRFSGSGSGTDFTLTISSLQPEDIATYYCQQGQTYPYTFGQGTKLEIKTKGPSRTVAAPSVFIFPPS DEQLKSGTASVVCLLNNFYPREAKVQWKVDNALQSGNSQESVTEQDSKDSTYSLSSTLTLSKADYEKHKVYACEVTHQG LSSPVTKSFNRGEC |
| | 2 | 411 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSSQVQLVESGGGVVQPGRSLRLSCAASGFTFTKAWMH WVRQAPGKQLEWVAQIKDKSNSYATYYADSVKGRFTISRDDSKNTLYLQMNSLRAEDTAVYYCRGVYYALSPFDYWG QGTLVTVSSRTASTKGPSVFPLAPCSRSTSESTAALGCLVKDYFPEPVTVSWNSGALTSGVHTFPAVLQSSGLYSLSSVVTV PSSSLGTKTYTCNVDHKPSNTKVDKRVESKYGPPCPPCPAPEAAGGPSVFLFPPKPKDTLMISRTPEVTCVVVDVSQEDPE VQFNWYVDGVEVHNAKTKPREEQFNSTYRVVSVLTVLHQDWLNGKEYKCKVSNKGLPSSIEKTISKAKGQPREPQVCTL PPSQEEMTKNQVSLSCAVKGFYPSDIAVEWESNGQPENNYKTTPPVLDSDGSFFLVSKLTVDKSRWQEGNVFSCSVMHEA LHNHYTQKSLSLSLG |
| | 3 | 412 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP VTVSWNSGALTSGVHTFPAVLQSSGLYSLSSVVTVPSSSLGTKTYTCNVDHKPSNTKVDKRVESKYGPPCPPCPAPEAAG GPSVFLFPPKPKDTLMISRTPEVTCVVVDVSQEDPEVQFNWYVDGVEVHNAKTKPREEQFNSTYRVVSVLTVLHQDWLN GKEYKCKVSNKGLPSSIEKTISKAKGQPREPQVYTLPPCQEEMTKNQVSLWCLVKGFYPSDIAVEWESNGQPENNYKTTP PVLDSDGSFFLYSKLTVDKSRWQEGNVFSCSVMHEALHNHYTQKSLSLSLG |
| | 4 | 413 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 16 N6/CD28sup x CD3mid_QQ IgG4 FALA/409K_ DKTHT linker | 1 | 414 | DIVMTQTPLSLSVTPGQPASISCKSSQSLVHQNAQTYLSWYLQKPGQSPQSLIYKVSNRFSGVPDRFSGSGSGTDFTLKISR VEAEDVGVYYCGQGTQYPFTFGSGTKVEIKDKTHTDIQMTQSPSSLSASVGDRVTITCQASQNIYVWLNWYQQKPGKAP KLLIYKASNLHTGVPSRFSGSGSGTDFTLTISSLQPEDIATYYCQQGQTYPYTFGQGTKLEIKDKTHTRTVAAPSVFIFPPSD EQLKSGTASVVCLLNNFYPREAKVQWKVDNALQSGNSQESVTEQDSKDSTYSLSSTLTLSKADYEKHKVYACEVTHQGL SSPVTKSFNRGEC |
| | 2 | 415 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSDKTHTQVQLVESGGGVVQPGRSLRLSCAASGFTFTKA WMHWVRQAPGKQLEWVAQIKDKSNSYATYYADSVKGRFTISRDDSKNTLYLQMNSLRAEDTAVYYCRGVYYALSPFD YWGQGTLVTVSSDKTHTASTKGPSVFPLAPCSRSTSESTAALGCLVKDYFPEPVTVSWNSGALTSGVHTFPAVLQSSGLYS |

TABLE 4A-continued

Trispecific binding protein polypeptide sequences.

| Molecule | Polypeptide Number (acc. to formula) | SEQ ID NO | Sequence |
|---|---|---|---|
| | | | LSSVVTVPSSSLGTKTYTCNVDHKPSNTKVDKRVESKYGPPCPPCPAPEAAGGPSVFLFPPKPKDTLMISRTPEVTCVVVD VSQEDPEVQFNWYVDGVEVHNAKTKPREEQFNSTYRVVSVLTVLHQDWLNGKEYKCKVSNKGLPSSIEKTISKAKGQPR EPQVCTLPPSQEEMTKNQVSLSCAVKGFYPSDIAVEWESNGQPENNYKTTPPVLDSDGSFFLVSKLTVDKSRWQEGNVFS CSVMHEALHNHYTQKSLSLSLG |
| | 3 | 416 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP VTVSWNSGALTSGVHTFPAVLQSSGLYSLSSVVTVPSSSLGTKTYTCNVDHKPSNTKVDKRVESKYGPPCPPCPAPEAAG GPSVFLFPPKPKDTLMISRTPEVTCVVVDVSQEDPEVQFNWYVDGVEVHNAKTKPREEQFNSTYRVVSVLTVLHQDWLN GKEYKCKVSNKGLPSSIEKTISKAKGQPREPQVYTLPPCQEEMTKNQVSLWCLVKGFYPSDIAVEWESNGQPENNYKTTP PVLDSDGSFFLYSKLTVDKSRWQEGNVFSCSVMHEALHNHYTQKSLSLSLG |
| | 4 | 417 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 17 N6/CD28sup x CD3mid IgG4 FALA/409K_ DKTHT linker | 1 | 418 | DIVMTQTPLSLSVTPGQPASISCKSSQSLVHNNANTYLSWYLQKPGQSPQSLIYKVSNRFSGVPDRFSGSGSGTDFTLKISR VEAEDVGVYYCGQGTQYPFTFGSGTKVEIKDKTHTDIQMTQSPSSLSASVGDRVTITCQASQNIYVWLNWYQQKPGKAP KLLIYKASNLHTGVPSRFSGSGSGTDFTLTISSLQPEDIATYYCQQGQTYPYTFGQGTKLEIKDKTHTRTVAAPSVFIFPPSD EQLKSGTASVVCLLNNFYPREAKVQWKVDNALQSGNSQESVTEQDSKDSTYSLSSTLTLSKADYEKHKVYACEVTHQGL SSPVTKSFNRGEC |
| | 2 | 419 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSDKTHTQVQLVESGGGVVQPGRSLRLSCAASGFTFTKA WMHWVRQAPGKQLEWVAQIKDKSNSYATYYADSVKGRFTISRDDSKNTLYLQMNSLRAEDTAVYYCRGVYYALSPFD YWGQGTLVTVSSDKTHTASTKGPSVFPLAPCSRSTSESTAALGCLVKDYFPEPVTVSWNSGALTSGVHTFPAVLQSSGLYS LSSVVTVPSSSLGTKTYTCNVDHKPSNTKVDKRVESKYGPPCPPCPAPEAAGGPSVFLFPPKPKDTLMISRTPEVTCVVVD VSQEDPEVQFNWYVDGVEVHNAKTKPREEQFNSTYRVVSVLTVLHQDWLNGKEYKCKVSNKGLPSSIEKTISKAKGQPR EPQVCTLPPSQEEMTKNQVSLSCAVKGFYPSDIAVEWESNGQPENNYKTTPPVLDSDGSFFLVSKLTVDKSRWQEGNVFS CSVMHEALHNHYTQKSLSLSLG |
| | 3 | 420 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP VTVSWNSGALTSGVHTFPAVLQSSGLYSLSSVVTVPSSSLGTKTYTCNVDHKPSNTKVDKRVESKYGPPCPPCPAPEAAG GPSVFLFPPKPKDTLMISRTPEVTCVVVDVSQEDPEVQFNWYVDGVEVHNAKTKPREEQFNSTYRVVSVLTVLHQDWLN GKEYKCKVSNKGLPSSIEKTISKAKGQPREPQVYTLPPCQEEMTKNQVSLWCLVKGFYPSDIAVEWESNGQPENNYKTTP PVLDSDGSFFLYSKLTVDKSRWQEGNVFSCSVMHEALHNHYTQKSLSLSLG |
| | 4 | 421 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 19 N6/CD28sup x CD3mid_QQ | 1 | 422 | DIVMTQTPLSLSVTPGQPASISCKSSQSLVHQNAQTYLSWYLQKPGQSPQSLIYKVSNRFSGVPDRFSGSGSGTDFTLKISR VEAEDVGVYYCGQGTQYPFTFGSGTKVEIKDKTHTDIQMTQSPSSLSASVGDRVTITCQASQNIYVWLNWYQQKPGKAP KLLIYKASNLHTGVPSRFSGSGSGTDFTLTISSLQPEDIATYYCQQGQTYPYTFGQGTKLEIKDKTHTRTVAAPSVFIFPPSD |

TABLE 4A-continued

| Trispecific binding protein polypeptide sequences. | | | |
|---|---|---|---|
| Molecule | Polypeptide Number (acc. to formula) | SEQ ID NO | Sequence |
| IgG1_NNAS_ DKTHT linker | | | EQLKSGTASVVCLLNNFYPREAKVQWKVDNALQSGNSQESVTEQDSKDSTYSLSSTLTLSKADYEKHKVYACEVTHQGL SSPVTKSFNRGEC |
| | 2 | 423 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSDKTHTQVQLVESGGGVVQPGRSLRLSCAASGFTFTKA WMHWVRQAPGKQLEWVAQIKDKSNSYATYYADSVKGRFTISRDDSKNTLYLQMNSLRAEDTAVYYCRGVYYALSPFD YWGQGTLVTVSSDKTHTASTKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSCDKTHTCPPCPAPELLGGPSVFLFPPKPKDTLMISRTPEVTCV VVDVSHEDPEVKFNWYVDGVEVHNAKTKPREEQYNNASRVVSVLTVLHQDWLNGKEYKCKVSNKALPAPlEKTISKAK GQPREPQVCTLPPSRDELTKNQVSLSCAVKGFYPSDIAVEWESNGQPENNYKTTPPVLDSDGSFFLVSKLTVDKSRWQQG NVFSCSVMHEALHNHYTQKSLSLSPG |
| | 3 | 424 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPSSKSTSGGTAALGCLVKDYFPEP VTVSWNSGALTSGVHTFPAVLQSSGLYSLSSVVTVPSSSLGTQTYICNVNHKPSNTKVDKKVEPKSCDKTHTCPPCPAPEL LGGPSVFLFPPKPKDTLMISRTPEVTCVVVDVSHEDPEVKFNWYVDGVEVHNAKTKPREEQYNNASRVVSVLTVLHQDW LNGKEYKCKVSNKALPAPIEKTISKAKGQPREPQVYTLPPCRDELTKNQVSLWCLVKGFYPSDIAVEWESNGQPENNYKT TPPVLDSDGSFFLYSKLTVDKSRWQQGNVFSCSVMHEALHNHYTQKSLSLSPG |
| | 4 | 425 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 21 N6/CD28sup x CD3mid_ DNAQ IgG4 FALA/409K_ DKTHT linker | 1 | 426 | DIVMTQTPLSLSVTPGQPASISCKSSQSLVHDNAQTYLSWYLQKPGQSPQSLIYKVSNRFSGVPDRFSGSGSGTDFTLKISR VEAEDVGVYYCGQGTQYPFTFGSGTKVEIKDKTHTDIQMTQSPSSLSASVGDRVTITCQASQNIYVWLNWYQQKPGKAP KLLIYKASNLHTGVPSRFSGSGSGTDFTLTISSLQPEDIATYYCQQGQTYPYTFGQGTKLEIKDKTHTRTVAAPSVFIFPPSD EQLKSGTASVVCLLNNFYPREAKVQWKVDNALQSGNSQESVTEQDSKDSTYSLSSTLTLSKADYEKHKVYACEVTHQGL SSPVTKSFNRGEC |
| | 2 | 427 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSDKTHTQVQLVESGGGVVQPGRSLRLSCAASGFTFTKA WMHWVRQAPGKQLEWVAQIKDKSNSYATYYADSVKGRFTISRDDSKNTLYLQMNSLRAEDTAVYYCRGVYYALSPFD YWGQGTLVTVSSDKTHTASTKGPSVFPLAPCSRSTSESTAALGCLVKDYFPEPVTVSWNSGALTSGVHTFPAVLQSSGLYS LSSVVTVPSSSLGTKTYTCNVDHKPSNTKVDKRVESKYGPPCPPCPAPEAAGGPSVFLFPPKPKDTLMISRTPEVTCVVVD VSQEDPEVQFNWYVDGVEVHNAKTKPREEQFNSTYRVVSVLTVLHQDWLNGKEYKCKVSNKGLPSSIEKTISKAKGQPR EPQVCTLPPSQEEMTKNQVSLSCAVKGFYPSDIAVEWESNGQPENNYKTTPPVLDSDGSFFLVSKLTVDKSRWQEGNVFS CSVMHEALHNHYTQKSLSLSLG |
| | 3 | 428 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP VTVSWNSGALTSGVHTFPAVLQSSGLYSLSSVVTVPSSSLGTKTYTCNVDHKPSNTKVDKRVESKYGPPCPPCPAPEAAG GPSVFLFPPKPKDTLMISRTPEVTCVVVDVSQEDPEVQFNWYVDGVEVHNAKTKPREEQFNSTYRVVSVLTVLHQDWLN GKEYKCKVSNKGLPSSIEKTISKAKGQPREPQVYTLPPCQEEMTKNQVSLWCLVKGFYPSDIAVEWESNGQPENNYKTTP PVLDSDGSFFLYSKLTVDKSRWQEGNVFSCSVMHEALHNHYTQKSLSLSLG |

TABLE 4A-continued

Trispecific binding protein polypeptide sequences.

| Molecule | Polypeptide Number (acc. to formula) | SEQ ID NO | Sequence |
|---|---|---|---|
| | 4 | 429 | YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| Trispecific 22 N6/CD28sup x CD3mid_ ENLQ IgG4 FALA/409K_ DKTHT linker | 1 | 430 | DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 431 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG |
| | 3 | 432 | RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG |
| | 4 | 433 | YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| Trispecific 23 N6/CD28sup x CD3mid_ ENLR IgG4 FALA/409K_ DKTHT linker | 1 | 434 | DIVMTQTPLSLSVTPGQPASISCKSSQSLVHENLRTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | 2 | 435 | QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVD |

TABLE 4A-continued

Trispecific binding protein polypeptide sequences.

| Molecule | Polypeptide Number (acc. to formula) | SEQ ID NO | Sequence |
|---|---|---|---|
| | | | VSQEDPEVQFNWYVDGVEVHNAKTKPREEQFNSTYRVVSVLTVLHQDWLNGKEYKCKVSNKGLPSSIEKTISKAKGQPR EPQVCTLPPSQEEMTKNQVSLSCAVKGFYPSDIAVEWESNGQPENNYKTTPPVLDSDGSFFLVSKLTVDKSRWQEGNVFS CSVMHEALHNHYTQKSLSLSLG |
| | 3 | 436 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP VTVSWNSGALTSGVHTFPAVLQSSGLYSLSSVVTVPSSSLGTKTYTCNVDHKPSNTKVDKRVESKYGPPCPPCPAPEAAG GPSVFLFPPKPKDTLMISRTPEVTCVVVDVSQEDPEVQFNWYVDGVEVHNAKTKPREEQFNSTYRVVSVLTVLHQDWLN GKEYKCKVSNKGLPSSIEKTISKAKGQPREPQVYTLPPCQEEMTKNQVSLWCLVKGFYPSDIAVEWESNGQPENNYKTTP PVLDSDGSFFLYSKLTVDKSRWQEGNVFSCSVMHEALHNHYTQKSLSLSLG |
| | 4 | 437 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 24 N6/CD28sup x CD3mid_ ENLF IgG4 FALA/409K_ DKTHT linker | 1 | 438 | DIVMTQTPLSLSVTPGQPASISCKSSQSLVHENLFTYLSWYLQKPGQSPQSLIYKVSNRFSGVPDRFSGSGSGTDFTLKISRV EAEDVGVYYCGQGTQYPFTFGSGTKVEIKDKTHTDIQMTQSPSSLSASVGDRVTITCQASQNIYVWLNWYQQKPGKAPK LLIYKASNLHTGVPSRFSGSGSGTDFTLTISSLQPEDIATYYCQQGQTYPYTFGQGTKLEIKDKTHTRTVAAPSVFIFPPSDE QLKSGTASVVCLLNNFYPREAKVQWKVDNALQSGNSQESVTEQDSKDSTYSLSSTLTLSKADYEKHKVYACEVTHQGLS SPVTKSFNRGEC |
| | 2 | 439 | QVQLVQSGAEVVKPGASVKVSCKASGYTFTSYYIHWVRQAPGQGLEWIGSIYPGNVNTNYAQKFQGRATLTVDTSISTA YMELSRLRSDDTAVYYCTRSHYGLDWNFDVWGKGTTVTVSSDKTHTQVQLVESGGGVVQPGRSLRLSCAASGFTFTKA WMHWVRQAPGKQLEWVAQIKDKSNSYATYYADSVKGRFTISRDDSKNTLYLQMNSLRAEDTAVYYCRGVYYALSPFD YWGQGTLVTVSSDKTHTASTKGPSVFPLAPCSRSTSESTAALGCLVKDYFPEPVTVSWNSGALTSGVHTFPAVLQSSGLYS LSSVVTVPSSSLGTKTYTCNVDHKPSNTKVDKRVESKYGPPCPPCPAPEAAGGPSVFLFPPKPKDTLMISRTPEVTCVVVD VSQEDPEVQFNWYVDGVEVHNAKTKPREEQFNSTYRVVSVLTVLHQDWLNGKEYKCKVSNKGLPSSIEKTISKAKGQPR EPQVCTLPPSQEEMTKNQVSLSCAVKGFYPSDIAVEWESNGQPENNYKTTPPVLDSDGSFFLVSKLTVDKSRWQEGNVFS CSVMHEALHNHYTQKSLSLSLG |
| | 3 | 440 | RAHLVQSGTAMKKPGASVRVSCQTSGYTFTAHILFWFRQAPGRGLEWVGWIKPQYGAVNFGGGFRDRVTLTRDVYREIA YMDIRGLKPDDTAVYYCARDRSYGDSSWALDAWGQGTTVVVSAASTKGPSVFPLAPCSRSTSESTAALGCLVKDYFPEP VTVSWNSGALTSGVHTFPAVLQSSGLYSLSSVVTVPSSSLGTKTYTCNVDHKPSNTKVDKRVESKYGPPCPPCPAPEAAG GPSVFLFPPKPKDTLMISRTPEVTCVVVDVSQEDPEVQFNWYVDGVEVHNAKTKPREEQFNSTYRVVSVLTVLHQDWLN GKEYKCKVSNKGLPSSIEKTISKAKGQPREPQVYTLPPCQEEMTKNQVSLWCLVKGFYPSDIAVEWESNGQPENNYKTTP PVLDSDGSFFLYSKLTVDKSRWQEGNVFSCSVMHEALHNHYTQKSLSLSLG |
| | 4 | 441 | YIHVTQSPSSLSVSIGDRVTINCQTSQGVGSDLHWYQHKPGRAPKLLIHHTSSVEDGVPSRFSGSGFHTSFNLTISDLQADDI ATYYCQVLQFFGRGSRLHIKRTVAAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| Trispecific 25 N6_rw52/ CD28sup x | 1 | 442 | DIVMTQTPLSLSVTPGQPASISCKSSQSLVHENLQTYLSWYLQKPGQSPQSLIYKVSNRFSGVPDRFSGSGSGTDFTLKISRV EAEDVGVYYCGQGTQYPFTFGSGTKVEIKDKTHTDIQMTQSPSSLSASVGDRVTITCQASQNIYVWLNWYQQKPGKAPK LLIYKASNLHTGVPSRFSGSGSGTDFTLTISSLQPEDIATYYCQQGQTYPYTFGQGTKLEIKDKTHTRTVAAPSVFIFPPSDE |

TABLE 4A-continued

Trispecific binding protein polypeptide sequences.

| Molecule | Polypeptide Number (acc. to formula) | SEQ ID NO | Sequence |
|---|---|---|---|
| CD3mid_ ENLQ IgG4 FALA/409K_ DKTHT linker | | | QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 443 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPCSRSTSESTAALGCLVKDYFPEPVTVSWNSGALTSGVHTFPAVLQSSGLYS<br>LSSVVTVPSSSLGTKTYTCNVDHKPSNTKVDKRVESKYGPPCPPCPAPEAAGGPSVFLFPPKPKDTLMISRTPEVTCVVVD<br>VSQEDPEVQFNWYVDGVEVHNAKTKPREEQFNSTYRVVSVLTVLHQDWLNGKEYKCKVSNKGLPSSIEKTISKAKGQPR<br>EPQVCTLPPSQEEMTKNQVSLSCAVKGFYPSDIAVEWESNGQPENNYKTTPPVLDSDGSFFLVSKLTVDKSRWQEGNVFS<br>CSVMHEALHNHYTQKSLSLSLG |
| | 3 | 444 | RAHLVQSGTAMKKPGASVRVSCQTSGYTFTAHILFWFRQAPGRGLEWVGWIKPQYGATNFGGGFRDRVTLTRDVYREIA<br>YMDIRGLKPDDTAVYYCARDRSYGDSSWALDAWGQGTTVVVSAASTKGPSVFPLAPCSRSTSESTAALGCLVKDYFPEP<br>VTVSWNSGALTSGVHTFPAVLQSSGLYSLSSVVTVPSSSLGTKTYTCNVDHKPSNTKVDKRVESKYGPPCPPCPAPEAAG<br>GPSVFLFPPKPKDTLMISRTPEVTCVVVDVSQEDPEVQFNWYVDGVEVHNAKTKPREEQFNSTYRVVSVLTVLHQDWLN<br>GKEYKCKVSNKGLPSSIEKTISKAKGQPREPQVYTLPPCQEEMTKNQVSLWCLVKGFYPSDIAVEWESNGQPENNYKTTP<br>PVLDSDGSFFLYSKLTVDKSRWQEGNVFSCSVMHEALHNHYTQKSLSLSLG |
| | 4 | 445 | YIHVTQSPSSLSVSIGDRVTINCQTSQGVGSDLHWYQHKPGRAPKLLIHHTSSSEEGVPSRFSGSGFHTSFNLTISDLQADDI<br>ATYYCQVLQFFGRGSRLHIKRTVAAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| Trispecific 26 N6_rw52/ CD28sup x CD3mid_ ENLF IgG4 FALA/409K_ DKTHT linker | 1 | 446 | DIVMTQTPLSLSVTPGQPASISCKSSQSLVHENLFTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 447 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPCSRSTSESTAALGCLVKDYFPEPVTVSWNSGALTSGVHTFPAVLQSSGLYS<br>LSSVVTVPSSSLGTKTYTCNVDHKPSNTKVDKRVESKYGPPCPPCPAPEAAGGPSVFLFPPKPKDTLMISRTPEVTCVVVD<br>VSQEDPEVQFNWYVDGVEVHNAKTKPREEQFNSTYRVVSVLTVLHQDWLNGKEYKCKVSNKGLPSSIEKTISKAKGQPR<br>EPQVCTLPPSQEEMTKNQVSLSCAVKGFYPSDIAVEWESNGQPENNYKTTPPVLDSDGSFFLVSKLTVDKSRWQEGNVFS<br>CSVMHEALHNHYTQKSLSLSLG |
| | 3 | 448 | RAHLVQSGTAMKKPGASVRVSCQTSGYTFTAHILFWFRQAPGRGLEWVGWIKPQYGATNFGGGFRDRVTLTRDVYREIA<br>YMDIRGLKPDDTAVYYCARDRSYGDSSWALDAWGQGTTVVVSAASTKGPSVFPLAPCSRSTSESTAALGCLVKDYFPEP<br>VTVSWNSGALTSGVHTFPAVLQSSGLYSLSSVVTVPSSSLGTKTYTCNVDHKPSNTKVDKRVESKYGPPCPPCPAPEAAG<br>GPSVFLFPPKPKDTLMISRTPEVTCVVVDVSQEDPEVQFNWYVDGVEVHNAKTKPREEQFNSTYRVVSVLTVLHQDWLN |

TABLE 4A-continued

Trispecific binding protein polypeptide sequences.

| Molecule | Polypeptide Number (acc. to formula) | SEQ ID NO | Sequence |
|---|---|---|---|
| | | | GKEYKCKVSNKGLPSSIEKTISKAKGQPREPQVYTLPPCQEEMTKNQVSLWCLVKGFYPSDIAVEWESNGQPENNYKTTP<br>PVLDSDGSFFLYSKLTVDKSRWQEGNVFSCSVMHEALHNHYTQKSLSLSLG |
| | 4 | 449 | YIHVTQSPSSLSVSIGDRVTINCQTSQGVGSDLHWYQHKPGRAPKLLIHHTSSSEEGVPSRFSGSGFHTSFNLTISDLQADDI<br>ATYYCQVLQFFGRGSRLHIKRTVAAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| Trispecific 27<br>N6_rw52/<br>CD28sup x<br>CD3mid_<br>ENLF<br>IgG1_NNAS_<br>DKTHT linker | 1 | 450 | DIVMTQTPLSLSVTPGQPASISCKSSQSLVHENLFTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 451 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPCPAPELLGGPSVFLFPPKPKDTLMISRTPEVTCV<br>VVDVSHEDPEVKFNWYVDGVEVHNAKTKPREEQYNNASRVVSVLTVLHQDWLNGKEYKCKVSNKALPAPIEKTISKAK<br>GQPREPQVCTLPPSRDELTKNQVSLSCAVKGFYPSDIAVEWESNGQPENNYKTTPPVLDSDGSFFLVSKLTVDKSRWQQG<br>NVFSCSVMHEALHNHYTQKSLSLSPG |
| | 3 | 452 | RAHLVQSGTAMKKPGASVRVSCQTSGYTFTAHILFWFRQAPGRGLEWVGWIKPQYGATNFGGGFRDRVTLTRDVYREIA<br>YMDIRGLKPDDTAVYYCARDRSYGDSSWALDAWGQGTTVVVSAASTKGPSVFPLAPSSKSTSGGTAALGCLVKDYFPEP<br>VTVSWNSGALTSGVHTFPAVLQSSGLYSLSSVVTVPSSSLGTQTYICNVNHKPSNTKVDKKVEPKSCDKTHTCPPCPAPEL<br>LGGPSVFLFPPKPKDTLMISRTPEVTCVVVDVSHEDPEVKFNWYVDGVEVHNAKTKPREEQYNNASRVVSVLTVLHQDW<br>LNGKEYKCKVSNKALPAPIEKTISKAKGQPREPQVYTLPPCRDELTKNQVSLWCLVKGFYPSDIAVEWESNGQPENNYKT<br>TPPVLDSDGSFFLYSKLTVDKSRWQQGNVFSCSVMHEALHNHYTQKSLSLSPG |
| | 4 | 453 | YIHVTQSPSSLSVSIGDRVTINCQTSQGVGSDLHWYQHKPGRAPKLLIHHTSSSEEGVPSRFSGSGFHTSFNLTISDLQADDI<br>ATYYCQVLQFFGRGSRLHIKRTVAAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| Trispecific 28<br>N6_FR3-03/<br>CD28sup x<br>CD3mid_<br>ENLQ IgG4<br>FALA/409K_<br>DKTHT linker | 1 | 454 | DIVMTQTPLSLSVTPGQPASISCKSSQSLVHENLQTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 455 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD |

TABLE 4A-continued

Trispecific binding protein polypeptide sequences.

| Molecule | Polypeptide Number (acc. to formula) | SEQ ID NO | Sequence |
|---|---|---|---|
| | | | YWGQGTLVTVSSDKTHTASTKGPSVFPLAPCSRSTSESTAALGCLVKDYFPEPVTVSWNSGALTSGVHTFPAVLQSSGLYS<br>LSSVVTVPSSSLGTKTYTCNVDHKPSNTKVDKRVESKYGPPCPPCPAPEAAGGPSVFLFPPKPKDTLMISRTPEVTCVVVD<br>VSQEDPEVQFNWYVDGVEVHNAKTKPREEQFNSTYRVVSVLTVLHQDWLNGKEYKCKVSNKGLPSSIEKTISKAKGQPR<br>EPQVCTLPPSQEEMTKNQVSLSCAVKGFYPSDIAVEWESNGQPENNYKTTPPVLDSDGSFFLVSKLTVDKSRWQEGNVFS<br>CSVMHEALHNHYTQKSLSLSLG |
| | 3 | 456 | RAHLVQSGTAMKKPGASVRVSCQTSGYTFTAHILFWFRQAPGRGLEWVGWIKPQYGAVNFGGGFRDRVTLTRQLSQDP<br>DDPDWGIAYMDIRGLKPDDTAVYYCARDRSYGDSSWALDAWGQGTTVVVSAASTKGPSVFPLAPCSRSTSESTAALGCL<br>VKDYFPEPVTVSWNSGALTSGVHTFPAVLQSSGLYSLSSVVTVPSSSLGTKTYTCNVDHKPSNTKVDKRVESKYGPPCPPC<br>PAPEAAGGPSVFLFPPKPKDTLMISRTPEVTCVVVDVSQEDPEVQFNWYVDGVEVHNAKTKPREEQFNSTYRVVSVLTVL<br>HQDWLNGKEYKCKVSNKGLPSSlEKTISKAKGQPREPQVYTLPPCQEEMTKNQVSLWCLVKGFYPSDIAVEWESNGQPE<br>NNYKTTPPVLDSDGSFFLYSKLTVDKSRWQEGNVFSCSVMHEALHNHYTQKSLSLSLG |
| | 4 | 457 | YIHVTQSPSSLSVSIGDRVTINCQTSQGVGSDLHWYQHKPGRAPKLLIHHTSSVEDGVPSRFSGSGFHTSFNLTISDLQADDI<br>ATYYCQVLQFFGRGSRLHIKRTVAAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| Trispecific 29 N6_FR3-03/ CD28sup x CD3mid_ ENLF IgG4 FALA/409K_ DKTHT linker | 1 | 458 | DIVMTQTPLSLSVTPGQPASISCKSSQSLVHENLFTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 459 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPCSRSTSESTAALGCLVKDYFPEPVTVSWNSGALTSGVHTFPAVLQSSGLYS<br>LSSVVTVPSSSLGTKTYTCNVDHKPSNTKVDKRVESKYGPPCPPCPAPEAAGGPSVFLFPPKPKDTLMISRTPEVTCVVVD<br>VSQEDPEVQFNWYVDGVEVHNAKTKPREEQFNSTYRVVSVLTVLHQDWLNGKEYKCKVSNKGLPSSIEKTISKAKGQPR<br>EPQVCTLPPSQEEMTKNQVSLSCAVKGFYPSDIAVEWESNGQPENNYKTTPPVLDSDGSFFLVSKLTVDKSRWQEGNVFS<br>CSVMHEALHNHYTQKSLSLSLG |
| | 3 | 460 | RAHLVQSGTAMKKPGASVRVSCQTSGYTFTAHILFWFRQAPGRGLEWVGWIKPQYGAVNFGGGFRDRVTLTRQLSQDP<br>DDPDWGIAYMDIRGLKPDDTAVYYCARDRSYGDSSWALDAWGQGTTVVVSAASTKGPSVFPLAPCSRSTSESTAALGCL<br>VKDYFPEPVTVSWNSGALTSGVHTFPAVLQSSGLYSLSSVVTVPSSSLGTKTYTCNVDHKPSNTKVDKRVESKYGPPCPPC<br>PAPEAAGGPSVFLFPPKPKDTLMISRTPEVTCVVVDVSQEDPEVQFNWYVDGVEVHNAKTKPREEQFNSTYRVVSVLTVL<br>HQDWLNGKEYKCKVSNKGLPSSlEKTISKAKGQPREPQVYTLPPCQEEMTKNQVSLWCLVKGFYPSDIAVEWESNGQPE<br>NNYKTTPPVLDSDGSFFLYSKLTVDKSRWQEGNVFSCSVMHEALHNHYTQKSLSLSLG |
| | 4 | 461 | YIHVTQSPSSLSVSIGDRVTINCQTSQGVGSDLHWYQHKPGRAPKLLIHHTSSVEDGVPSRFSGSGFHTSFNLTISDLQADDI<br>ATYYCQVLQFFGRGSRLHIKRTVAAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| Trispecific 30 | 1 | 462 | DIVMTQTPLSLSVTPGQPASISCKSSQSLVHENLQTYLSWYLQKPGQSPQSLIYKVSNRFSGVPDRFSGSGSGTDFTLKISRV |

TABLE 4A-continued

Trispecific binding protein polypeptide sequences.

| Molecule | Polypeptide Number (acc. to formula) | SEQ ID NO | Sequence |
|---|---|---|---|
| N6_FR3-03/ CD28sup x CD3mid_ ENLQIgG1_ NNAS_DKTHT linker | | | EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 463 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPCPAPELLGGPSVFLFPPKPKDTLMISRTPEVTCV<br>VVDVSHEDPEVKFNWYVDGVEVHNAKTKPREEQYNNASRVVSVLTVLHQDWLNGKEYKCKVSNKALPAPIEKTISKAK<br>GQPREPQVCTLPPSRDELTKNQVSLSCAVKGFYPSDIAVEWESNGQPENNYKTTPPVLDSDGSFFLVSKLTVDKSRWQQG<br>NVFSCSVMHEALHNHYTQKSLSLSPG |
| | 3 | 464 | RAHLVQSGTAMKKPGASVRVSCQTSGYTFTAHILFWFRQAPGRGLEWVGWIKPQYGAVNFGGGFRDRVTLTRQLSQDP<br>DDPDWGIAYMDIRGLKPDDTAVYYCARDRSYGDSSWALDAWGQGTTVVVSAASTKGPSVFPLAPSSKSTSGGTAALGC<br>LVKDYFPEPVTVSWNSGALTSGVHTFPAVLQSSGLYSLSSVVTVPSSSLGTQTYICNVNHKPSNTKVDKKVEPKSCDKTHT<br>CPPCPAPELLGGPSVFLFPPKPKDTLMISRTPEVTCVVVDVSHEDPEVKFNWYVDGVEVHNAKTKPREEQYNNASRVVSV<br>LTVLHQDWLNGKEYKCKVSNKALPAPlEKTISKAKGQPREPQVYTLPPCRDELTKNQVSLWCLVKGFYPSDIAVEWESNG<br>QPENNYKTTPPVLDSDGSFFLYSKLTVDKSRWQQGNVFSCSVMHEALHNHYTQKSLSLSPG |
| | 4 | 465 | YIHVTQSPSSLSVSIGDRVTINCQTSQGVGSDLHWYQHKPGRAPKLLIHHTSSVEDGVPSRFSGSGFHTSFNLTISDLQADDI<br>ATYYCQVLQFFGRGSRLHIKRTVAAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| Trispecific 31 N6_FR3-03/ CD28sup x CD3mid_ ENLF IgG1_NNAS_ DKTHT linker | 1 | 466 | DIVMTQTPLSLSVTPGQPASISCKSSQSLVHENLFTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 467 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPSSKSTSGGTAALGCLVKDYFPEPVTVSWNSGALTSGVHTFPAVLQSSGLY<br>SLSSVVTVPSSSLGTQTYICNVNHKPSNTKVDKKVEPKSCDKTHTCPPCPAPELLGGPSVFLFPPKPKDTLMISRTPEVTCV<br>VVDVSHEDPEVKFNWYVDGVEVHNAKTKPREEQYNNASRVVSVLTVLHQDWLNGKEYKCKVSNKALPAPlEKTISKAK<br>GQPREPQVCTLPPSRDELTKNQVSLSCAVKGFYPSDIAVEWESNGQPENNYKTTPPVLDSDGSFFLVSKLTVDKSRWQQG<br>NVFSCSVMHEALHNHYTQKSLSLSPG |
| | 3 | 468 | RAHLVQSGTAMKKPGASVRVSCQTSGYTFTAHILFWFRQAPGRGLEWVGWIKPQYGAVNFGGGFRDRVTLTRQLSQDP<br>DDPDWGIAYMDIRGLKPDDTAVYYCARDRSYGDSSWALDAWGQGTTVVVSAASTKGPSVFPLAPSSKSTSGGTAALGC |

TABLE 4A-continued

Trispecific binding protein polypeptide sequences.

| Molecule | Polypeptide Number (acc. to formula) | SEQ ID NO | Sequence |
| --- | --- | --- | --- |
| | | | LVKDYFPEPVTVSWNSGALTSGVHTFPAVLQSSGLYSLSSVVTVPSSSLGTQTYICNVNHKPSNTKVDKKVEPKSCDKTHT<br>CPPCPAPELLGGPSVFLFPPKPKDTLMISRTPEVTCVVVDVSHEDPEVKFNWYVDGVEVHNAKTKPREEQYNNASRVVSV<br>LTVLHQDWLNGKEYKCKVSNKALPAPIEKTISKAKGQPREPQVYTLPPCRDELTKNQVSLWCLVKGFYPSDIAVEWESNG<br>QPENNYKTTPPVLDSDGSFFLYSKLTVDKSRWQQGNVFSCSVMHEALHNHYTQKSLSLSPG |
| | 4 | 469 | YIHVTQSPSSLSVSIGDRVTINCQTSQGVGSDLHWYQHKPGRAPKLLIHHTSSVEDGVPSRFSGSGFHTSFNLTISDLQADDI<br>ATYYCQVLQFFGRGSRLHIKRTVAAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| Trispecific 34<br>VRC01.23/<br>CD28sup x<br>CD3mid_<br>ENLQ IgG4<br>FALA/409K_<br>DKTHT linker | 1 | 470 | DIVMTQTPLSLSVTPGQPASISCKSSQSLVHENLQTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 471 | QVQLVQSGAEVVKPGASVKVSCKASGYTFTSYYIHWVRQAPGQGLEWIGSIYPGNVNTNYAQKFQGRATLTVDTSISTA<br>YMELSRLRSDDTAVYYCTRSHYGLDWNFDVWGKGTTVTVSSDKTHTQVQLVESGGGVVQPGRSLRLSCAASGFTFTKA<br>WMHWVRQAPGKQLEWVAQIKDKSNSYATYYADSVKGRFTISRDDSKNTLYLQMNSLRAEDTAVYYCRGVYYALSPFD<br>YWGQGTLVTVSSDKTHTASTKGPSVFPLAPCSRSTSESTAALGCLVKDYFPEPVTVSWNSGALTSGVHTFPAVLQSSGLYS<br>LSSVVTVPSSSLGTKTYTCNVDHKPSNTKVDKRVESKYGPPCPPCPAPEAAGGPSVFLFPPKPKDTLMISRTPEVTCVVVD<br>VSQEDPEVQFNWYVDGVEVHNAKTKPREEQFNSTYRVVSVLTVLHQDWLNGKEYKCKVSNKGLPSSIEKTISKAKGQPR<br>EPQVCTLPPSQEEMTKNQVSLSCAVKGFYPSDIAVEWESNGQPENNYKTTPPVLDSDGSFFLVSKLTVDKSRWQEGNVFS<br>CSVMHEALHNHYTQKSLSLSLG |
| | 3 | 472 | QVQLVQSGGQMKKPGESMRISCRASGYEFIDCTLNWIRLAPGKRPEWMGWLKPRWGAVNYARPLQGRVTMTRQLSQDP<br>DDPDWGTAFLELRSLTVDDTAVYFCTRGKNCDYNWDEERWGRGTPVIVSSASTKGPSVFPLAPCSRSTSESTAALGCLVK<br>DYFPEPVTVSWNSGALTSGVHTFPAVLQSSGLYSLSSVVTVPSSSLGTKTYTCNVDHKPSNTKVDKRVESKYGPPCPPCPA<br>PEAAGGPSVFLFPPKPKDTLMISRTPEVTCVVVDVSQEDPEVQFNWYVDGVEVHNAKTKPREEQFNSTYRVVSVLTVLHQ<br>DWLNGKEYKCKVSNKGLPSSIEKTISKAKGQPREPQVYTLPPCQEEMTKNQVSLWCLVKGFYPSDIAVEWESNGQPENN<br>YKTTPPVLDSDGSFFLYSKLTVDKSRWQEGNVFSCSVMHEALHNHYTQKSLSLSLG |
| | 4 | 473 | LTQSPGTLSLSPGETAIISCRTSQYGSLAWYQQRPGQAPRLVIYSGSTRAAGIPDRFSGSRWGPDYNLTISNLESGDFGVYY<br>CQQYEFFGQGTKVQVDIKRTVAAPSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| Trispecific 35<br>VRC01.23/<br>CD28sup x<br>CD3mid_<br>ENLF IgG4<br>FALA/409K_<br>DKTHT linker | 1 | 474 | DIVMTQTPLSLSVTPGQPASISCKSSQSLVHENLFTYLSWYLQKPGQSPQSLIYKVSNRFSGVPDRFSGSGSGTDFTLKISRV<br>EAEDVGVYYCGQGTQYPFTFGSGTKVEIKDKTHTDIQMTQSPSSLSASVGDRVTITCQASQNIYVWLNWYQQKPGKAPK<br>LLIYKASNLHTGVPSRFSGSGSGTDFTLTISSLQPEDIATYYCQQGQTYPYTFGQGTKLEIKDKTHTRTVAAPSVFIFPPSDE<br>QLKSGTASVVCLLNNFYPREAKVQWKVDNALQSGNSQESVTEQDSKDSTYSLSSTLTLSKADYEKHKVYACEVTHQGLS<br>SPVTKSFNRGEC |
| | 2 | 475 | QVQLVQSGAEVVKPGASVKVSCKASGYTFTSYYIHWVRQAPGQGLEWIGSIYPGNVNTNYAQKFQGRATLTVDTSISTA |

TABLE 4A-continued

Trispecific binding protein polypeptide sequences.

| Molecule | Polypeptide Number (acc. to formula) | SEQ ID NO | Sequence |
|---|---|---|---|
| | | | YMELSRLRSDDTAVYYCTRSHYGLDWNFDVWGKGTTVTVSSDKTHTQVQLVESGGGVVQPGRSLRLSCAASGFTFTKA WMHWVRQAPGKQLEWVAQIKDKSNSYATYYADSVKGRFTISRDDSKNTLYLQMNSLRAEDTAVYYCRGVYYALSPFD YWGQGTLVTVSSDKTHTASTKGPSVFPLAPCSRSTSESTAALGCLVKDYFPEPVTVSWNSGALTSGVHTFPAVLQSSGLYS LSSVVTVPSSSLGTKTYTCNVDHKPSNTKVDKRVESKYGPPCPPCPAPEAAGGPSVFLFPPKPKDTLMISRTPEVTCVVVD VSQEDPEVQFNWYVDGVEVHNAKTKPREEQFNSTYRVVSVLTVLHQDWLNGKEYKCKVSNKGLPSSIEKTISKAKGQPR EPQVCTLPPSQEEMTKNQVSLSCAVKGFYPSDIAVEWESNGQPENNYKTTPPVLDSDGSFFLVSKLTVDKSRWQEGNVFS CSVMHEALHNHYTQKSLSLSLG |
| | 3 | 476 | QVQLVQSGGQMKKPGESMRISCRASGYEFIDCTLNWIRLAPGKRPEWMGWLKPRWGAVNYARPLQGRVTMTRQLSQDP DDPDWGTAFLELRSLTVDDTAVYFCTRGKNCDYNWDEERWGRGTPVIVSSASTKGPSVFPLAPCSRSTSESTAALGCLVK DYFPEPVTVSWNSGALTSGVHTFPAVLQSSGLYSLSSVVTVPSSSLGTKTYTCNVDHKPSNTKVDKRVESKYGPPCPPCPA PEAAGGPSVFLFPPKPKDTLMISRTPEVTCVVVDVSQEDPEVQFNWYVDGVEVHNAKTKPREEQFNSTYRVVSVLTVLHQ DWLNGKEYKCKVSNKGLPSSIEKTISKAKGQPREPQVYTLPPCQEEMTKNQVSLWCLVKGFYPSDIAVEWESNGQPENN YKTTPPVLDSDGSFFLYSKLTVDKSRWQEGNVFSCSVMHEALHNHYTQKSLSLSLG |
| | 4 | 477 | LTQSPGTLSLSPGETAIISCRTSQYGSLAWYQQRPGQAPRLVIYSGSTRAAGIPDRFSGSRWGPDYNLTISNLESGDFGVYY CQQYEFFGQGTKVQVDIKRTVAAPSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |

TABLE 5

Trispecific binding protein polynucleotide sequences

| Molecule | Polypeptide Number (acc. to formula) | SEQ ID NO | Sequence |
|---|---|---|---|
| Trispecific 1 VRC07_523/ CD28sup x CD3mid IgG1 LALA/P329A | 1 | 478 | GACATCGTGATGACCCAGACCCCCCTGAGCCTGAGCGTGACACCTGGACAGCCTGCCAGCATCAGCTGCAAGAGCA<br>GCCAGAGCCTGGTGCACAACAACGCCAACACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGGCCAGCCCAAGGCCGCCCCCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGAAC<br>TGGTATCAGCAGAAGCCCGGCAAGGCCCCCAAGCTGCTGATCTACAAGGCCAGCAACCTGCACACCGGCGTGCCCA<br>GCAGATTTTCTGGCAGCGGCTCCGGCACCGACTTCACCCTGACAATCAGCTCCCTGCAGCCCGAGGACATTGCCACC<br>TACTACTGCCAGCAGGGCCAGACCTACCCCTACACCTTTGGCCAGGGCACCAAGCTGGAAATCAAGACCAAGGGCC<br>CCAGCCGTACGGTGGCCGCTCCCAGCGTGTTCATCTTCCCACCTAGCGACGAGCAGCTGAAGTCCGGCACAGCCTCT<br>GTCGTGTGCCTGCTGAACAACTTCTACCCCCGCGAGGCCAAAGTGCAGTGGAAGGTGGACAACGCCCTGCAGAGCG<br>GCAACAGCCAGGAAAGCGTGACCGAGCAGGACAGCAAGGACTCCACCTACAGCCTGAGCAGCACCCTGACACTGAG<br>CAAGGCCGACTACGAGAAGCACAAGGTGTACGCCTGCGAAGTGACCCACCAGGGCCTGTCTAGCCCCGTGACCAAG<br>AGCTTCAACCGGGGCGAGTGT |
| | 2 | 479 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCAGCCAGGTGCAGCTGGTGGAATCT<br>GGCGGCGGAGTGGTGCAGCCTGGCAGAAGCCTGAGACTGAGCTGTGCCGCCAGCGGCTTCACCTTCACCAAGGCCT<br>GGATGCACTGGGTGCGCCAGGCCCCTGGAAAGCAGCTGGAATGGGTGGCCCAGATCAAGGACAAGAGCAACAGCTA<br>CGCCACCTACTACGCCGACAGCGTGAAGGGCCGGTTCACCATCAGCCGGGACGACAGCAAGAACACCCTGTACCTG<br>CAGATGAACAGCCTGCGGGCCGAGGACACCGCCGTGTACTACTGTCGGGGCGTGTACTATGCCCTGAGCCCCTTCGA<br>TTACTGGGGCCAGGGAACCCTCGTGACCGTGTCTAGTCGGACCGCCAGCACAAAGGGCCCCAGCGTGTTCCCTCTGG<br>CCCCTAGCAGCAAGAGCACATCTGGCGGAACAGCCGCCCTGGGCTGCCTCGTGAAGGACTACTTTCCCGAGCCCGTG<br>ACCGTGTCCTGGAATTCTGGCGCCCTGACCAGCGGCGTGCACACCTTTCCAGCTGTGCTGCAGTCCAGCGGCCTGTAC<br>AGCCTGAGCAGCGTCGTGACAGTGCCCAGCAGCTCTCTGGGCACCCAGACCTACATCTGCAACGTGAACCACAAGCC<br>CAGCAACACCAAGGTGGACAAGAAGGTGGAACCCAAGAGCTGCGACAAGACCCACACCTGTCCCCCTTGTCCTGCC<br>CCCGAAGCCGCCGGAGGCCCTTCCGTGTTCCTGTTCCCCCCAAAGCCCAAGGACACCCTGATGATCAGCCGGACCCC<br>CGAAGTGACCTGCGTGGTGGTGGATGTGTCCCACGAGGACCCTGAAGTGAAGTTCAATTGGTACGTGGACGGCGTGG<br>AAGTGCACAACGCCAAGACCAAGCCAAGAGAGGAACAGTACAACAGCACCTACCGGGTGGTGTCCGTGCTGACCGT<br>GCTGCACCAGGACTGGCTGAACGGCAAAGAGTACAAGTGCAAGGTGTCCAACAAGGCCCTGGCCGCCCCCATCGAG<br>AAAACCATCAGCAAGGCCAAGGGCCAGCCCCGCGAACCCCAGGTGTGCACACTGCCCCCAAGCAGGGACGAGCTGA<br>CCAAGAACCAGGTGTCCCTGAGCTGTGCCGTGAAAGGCTTCTACCCCTCCGATATCGCCGTGGAATGGGAGAGCAAC<br>GGCCAGCCCGAGAACAACTACAAGACCACCCCCCCTGTGCTGGACAGCGACGGCTCATTCTTCCTGGTGTCCAAGCT<br>GACAGTGGACAAGTCCCGGTGGCAGCAGGGCAACGTGTTCAGCTGCTCCGTGATGCACGAGGCCCTGCACAACCAC<br>TACACCCAGAAGTCCCTGAGCCTGAGCCCCGGCTAGTGA |
| | 3 | 480 | CAAGTGCGGCTGTCTCAGTCTGGCGGCCAGATGAAGAAACCCGGCGACAGCATGCGGATCAGCTGCAGAGCCAGCG<br>GCTACGAGTTCATCAACTGCCCCATCAACTGGATCAGACTGGCCCCTGGCAAGCGGCCTGAGTGGATGGGATGGATG<br>AAGCCCAGACACGGGGCCGTGTCCTACGCCAGACAGCTGCAGGGCAGAGTGACCATGACCCGGGACATGTACAGCG<br>AGACAGCCTTCCTGGAACTGCGGAGCCTGACCAGCGACGATACCGCCGTGTACTTCTGCACCCGGGGCAAGTACTGC<br>ACCGCCAGAGACTACTACAACTGGGACTTCGAGCACTGGGGCCAGGGCACACCTGTGACAGTGTCTAGCGCTTCGAC |

TABLE 5-continued

| Trispecific binding protein polynucleotide sequences | | | |
|---|---|---|---|
| Molecule | Polypeptide Number (acc. to formula) | SEQ ID NO | Sequence |
| | | | CAAGGGCCCCAGCGTGTTCCCTCTGGCCCCTAGCAGCAAGAGCACATCTGGCGGAACAGCCGCCCTGGGCTGCCTCG<br>TGAAGGACTACTTTCCCGAGCCCGTGACCGTGTCCTGGAATTCTGGCGCCCTGACCAGCGGCGTGCACACCTTTCCA<br>GCTGTGCTGCAGTCCAGCGGCCTGTACAGCCTGAGCAGCGTCGTGACAGTGCCCAGCAGCTCTCTGGGCACCCAGAC<br>CTACATCTGCAACGTGAACCACAAGCCCAGCAACACCAAGGTGGACAAGAAGGTGGAACCCAAGAGCTGCGACAAG<br>ACCCACACCTGTCCCCCTTGTCCTGCCCCCGAAGCCGCCGGAGGCCCTTCCGTGTTCCTGTTCCCCCCAAAGCCCAAG<br>GACACCCTGATGATCAGCCGGACCCCCGAAGTGACCTGCGTGGTGGTGGATGTGTCCCACGAGGACCCTGAAGTGA<br>AGTTCAATTGGTACGTGGACGGCGTGGAAGTGCACAACGCCAAGACCAAGCCAAGAGAGGAACAGTACAACAGCAC<br>CTACCGGGTGGTGTCCGTGCTGACCGTGCTGCACCAGGACTGGCTGAACGGCAAAGAGTACAAGTGCAAGGTGTCC<br>AACAAGGCCCTGGCCGCCCCCATCGAGAAAACCATCAGCAAGGCCAAGGGCCAGCCCCGCGAACCCCAGGTGTACA<br>CACTGCCCCCATGCAGGGACGAGCTGACCAAGAACCAGGTGTCCCTGTGGTGTCTGGTGAAAGGCTTCTACCCCTCC<br>GATATCGCCGTGGAATGGGAGAGCAACGGCCAGCCCGAGAACAACTACAAGACCACCCCCCCTGTGCTGGACAGCG<br>ACGGCTCATTCTTCCTGTACTCCAAGCTGACAGTGGACAAGTCCCGGTGGCAGCAGGGCAACGTGTTCAGCTGCTCC<br>GTGATGCACGAGGCCCTGCACAACCACTACACCCAGAAGTCCCTGAGCCTGAGCCCCGGC |
| | 4 | 481 | AGCCTGACACAGAGCCCTGGCACCCTGTCACTGAGCCCAGGCGAGACAGCCATCATCAGCTGCCGGACAAGCCAGT<br>ACGGCAGCCTGGCCTGGTATCAGCAGAGGCCTGGACAGGCCCCCAGACTCGTGATCTACAGCGGCAGCACAAGAGC<br>CGCCGGAATCCCCGATAGATTCAGCGGCTCCAGATGGGGACCCGACTACAACCTGACCATCAGCAACCTGGAAAGC<br>GGCGACTTCGGCGTGTACTACTGCCAGCAGTACGAGTTCTTCGGCCAGGGCACCAAGGTGCAGGTGGACATCAAGCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| Trispecific 2 VRC07_523/ CD28sup x CD3mid IgG1 NNAS | 1 | 482 | GACATCGTGATGACCCAGACCCCCCTGAGCCTGAGCGTGACACCTGGACAGCCTGCCAGCATCAGCTGCAAGAGCA<br>GCCAGAGCCTGGTGCACAACAACGCCAACACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGGCCAGCCCAAGGCCGCCCCCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGAAC<br>TGGTATCAGCAGAAGCCCGGCAAGGCCCCCAAGCTGCTGATCTACAAGGCCAGCAACCTGCACACCGGCGTGCCCA<br>GCAGATTTTCTGGCAGCGGCTCCGGCACCGACTTCACCCTGACAATCAGCTCCCTGCAGCCCGAGGACATTGCCACC<br>TACTACTGCCAGCAGGGCCAGACCTACCCCTACACCTTTGGCCAGGGCACCAAGCTGGAAATCAAGACCAAGGGCC<br>CCAGCCGTACGGTGGCCGCTCCCAGCGTGTTCATCTTCCCACCTAGCGACGAGCAGCTGAAGTCCGGCACAGCCTCT<br>GTCGTGTGCCTGCTGAACAACTTCTACCCCCGCGAGGCCAAAGTGCAGTGGAAGGTGGACAACGCCCTGCAGAGCG<br>GCAACAGCCAGGAAAGCGTGACCGAGCAGGACAGCAAGGACTCCACCTACAGCCTGAGCAGCACCCTGACACTGAG<br>CAAGGCCGACTACGAGAAGCACAAGGTGTACGCCTGCGAAGTGACCCACCAGGGCCTGTCTAGCCCCGTGACCAAG<br>AGCTTCAACCGGGGCGAGTGT |
| | 2 | 483 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCAGCCAGGTGCAGCTGGTGGAATCT<br>GGCGGCGGAGTGGTGCAGCCTGGCAGAAGCCTGAGACTGAGCTGTGCCGCCAGCGGCTTCACCTTCACCAAGGCCT<br>GGATGCACTGGGTGCGCCAGGCCCCTGGAAAGCAGCTGGAATGGGTGGCCCAGATCAAGGACAAGAGCAACAGCTA |

TABLE 5-continued

Trispecific binding protein polynucleotide sequences

| Molecule | Polypeptide Number (acc. to formula) | SEQ ID NO | Sequence |
|---|---|---|---|
| | | | CGCCACCTACTACGCCGACAGCGTGAAGGGCCGGTTCACCATCAGCCGGGACGACAGCAAGAACACCCTGTACCTG CAGATGAACAGCCTGCGGGCCGAGGACACCGCCGTGTACTACTGTCGGGGCGTGTACTATGCCCTGAGCCCCTTCGA TTACTGGGGCCAGGGAACCCTCGTGACCGTGTCTAGTCGGACCGCCAGCACAAAGGGCCCCAGCGTGTTCCCTCTGG CCCCTAGCAGCAAGAGCACATCTGGCGGAACAGCCGCCCTGGGCTGCCTCGTGAAGGACTACTTTCCCGAGCCCGTG ACCGTGTCCTGGAATTCTGGCGCCCTGACCAGCGGCGTGCACACCTTTCCAGCTGTGCTGCAGTCCAGCGGCCTGTAC AGCCTGAGCAGCGTCGTGACAGTGCCCAGCAGCTCTCTGGGCACCCAGACCTACATCTGCAACGTGAACCACAAGCC CAGCAACACCAAGGTGGACAAGAAGGTGGAACCCAAGAGCTGCGACAAGACCCACACCTGTCCCCCTTGTCCTGCC CCCGAACTGCTGGGAGGCCCTTCCGTGTTCCTGTTCCCCCCAAAGCCCAAGGACACCCTGATGATCAGCCGGACCCC CGAAGTGACCTGCGTGGTGGTGGATGTGTCCCACGAGGACCCTGAAGTGAAGTTCAATTGGTACGTGGACGGCGTGG AAGTGCACAACGCCAAGACCAAGCCAAGAGAGGAACAGTACAACAATGCCTCCCGGGTGGTGTCCGTGCTGACCGT GCTGCACCAGGACTGGCTGAACGGCAAAGAGTACAAGTGCAAGGTGTCCAACAAGGCCCTGCCTGCCCCCATCGAG AAAACCATCAGCAAGGCCAAGGGCCAGCCCCGCGAACCCCAGGTGTGCACACTGCCCCCAAGCAGGGACGAGCTGA CCAAGAACCAGGTGTCCCTGAGCTGTGCCGTGAAAGGCTTCTACCCCTCCGATATCGCCGTGGAATGGGAGAGCAAC GGCCAGCCCGAGAACAACTACAAGACCACCCCCCCTGTGCTGGACAGCGACGGCTCATTCTTCCTGGTGTCCAAGCT GACAGTGGACAAGTCCCGGTGGCAGCAGGGCAACGTGTTCAGCTGCTCCGTGATGCACGAGGCCCTGCACAACCAC TACACCCAGAAGTCCCTGAGCCTGAGCCCCGGC |
| | 3 | 484 | CAAGTGCGGCTGTCTCAGTCTGGCGGCCAGATGAAGAAACCCGGCGACAGCATGCGGATCAGCTGCAGAGCCAGCG GCTACGAGTTCATCAACTGCCCCATCAACTGGATCAGACTGGCCCCTGGCAAGCGGCCTGAGTGGATGGGATGGATG AAGCCCAGACACGGGGCCGTGTCCTACGCCAGACAGCTGCAGGGCAGAGTGACCATGACCCGGGACATGTACAGCG AGACAGCCTTCCTGGAACTGCGGAGCCTGACCAGCGACGATACCGCCGTGTACTTCTGCACCCGGGGCAAGTACTGC ACCGCCAGAGACTACTACAACTGGGACTTCGAGCACTGGGGCCAGGGCACACCTGTGACAGTGTCTAGCGCTTCGAC CAAGGGCCCATCGGTCTTCCCCCTGGCACCCTCCTCCAAGAGCACCTCTGGGGGCACAGCGGCCCTGGGCTGCCTGG TCAAGGACTACTTCCCCGAACCGGTGACGGTGTCGTGGAACTCAGGCGCCCTGACCAGCGGCGTGCACACCTTCCCG GCTGTCCTACAGTCCTCAGGACTCTACTCCCTCAGCAGCGTGGTGACCGTGCCCTCCAGCAGCTTGGGCACCCAGAC CTACATCTGCAACGTGAATCACAAGCCCAGCAACACCAAGGTGGACAAGAAAGTTGAGCCCAAATCTTGTGACAAA ACTCACACATGCCCACCGTGCCCAGCACCTGAACTCCTGGGGGGACCGTCAGTCTTCCTCTTCCCCCCAAAACCCAA GGACACCCTCATGATCTCCCGGACCCCTGAGGTCACATGCGTGGTGGTGGACGTGAGCCACGAAGACCCTGAGGTCA AGTTCAACTGGTATGTTGACGGCGTGGAGGTGCATAATGCCAAGACAAAGCCGCGGGAGGAGCAGTACAACAATGC CTCCCGTGTGGTCAGCGTCCTCACCGTCCTGCACCAGGACTGGCTGAATGGCAAGGAGTACAAGTGCAAGGTCTCCA ACAAAGCCCTCCCAGCCCCCATCGAGAAAACCATCTCCAAAGCCAAAGGGCAGCCCCGAGAACCACAGGTGTACAC CCTGCCCCCATGCCGGGATGAGCTGACCAAGAATCAAGTCAGCCTGTGGTGCCTGGTAAAAGGCTTCTATCCCAGCG ACATCGCCGTGGAGTGGGAGAGCAATGGGCAGCCGGAGAACAACTACAAGACCACGCCTCCCGTGCTGGACTCCGA CGGCTCCTTCTTCCTCTATTCAAAACTCACCGTGGACAAGAGCAGGTGGCAGCAGGGGAACGTCTTCTCATGCTCCGT GCTGCATGAGGCTCTGCACAGCCACTACACGCAGAAGAGCCTCTCCCTGTCTCCGGGT |
| | 4 | 485 | AGCCTGACACAGAGCCCTGGCACCCTGTCACTGAGCCCAGGCGAGACAGCCATCATCAGCTGCCGGACAAGCCAGT ACGGCAGCCTGGCCTGGTATCAGCAGAGGCCTGGACAGGCCCCCAGACTCGTGATCTACAGCGGCAGCACAAGAGC CGCCGGAATCCCCGATAGATTCAGCGGCTCCAGATGGGGACCCGACTACAACCTGACCATCAGCAACCTGGAAAGC GGCGACTTCGGCGTGTACTACTGCCAGCAGTACGAGTTCTTCGGCCAGGGCACCAAGGTGCAGGTGGACATCAAGCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |

TABLE 5-continued

| Trispecific binding protein polynucleotide sequences | | | |
|---|---|---|---|
| Molecule | Polypeptide Number (acc. to formula) | SEQ ID NO | Sequence |
| Trispecific 3 VRC07_523/ CD28sup x CD3mid IgG4 FALA/409K | 1 | 486 | GACATCGTGATGACCCAGACCCCCCTGAGCCTGAGCGTGACACCTGGACAGCCTGCCAGCATCAGCTGCAAGAGCA<br>GCCAGAGCCTGGTGCACAACAACGCCAACACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGGCCAGCCCAAGGCCGCCCCCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGAAC<br>TGGTATCAGCAGAAGCCCGGCAAGGCCCCCAAGCTGCTGATCTACAAGGCCAGCAACCTGCACACCGGCGTGCCCA<br>GCAGATTTTCTGGCAGCGGCTCCGGCACCGACTTCACCCTGACAATCAGCTCCCTGCAGCCCGAGGACATTGCCACC<br>TACTACTGCCAGCAGGGCCAGACCTACCCCTACACCTTTGGCCAGGGCACCAAGCTGGAAATCAAGACCAAGGGCC<br>CCAGCCGTACGGTGGCCGCTCCCAGCGTGTTCATCTTCCCACCTAGCGACGAGCAGCTGAAGTCCGGCACAGCCTCT<br>GTCGTGTGCCTGCTGAACAACTTCTACCCCCGCGAGGCCAAAGTGCAGTGGAAGGTGGACAACGCCCTGCAGAGCG<br>GCAACAGCCAGGAAAGCGTGACCGAGCAGGACAGCAAGGACTCCACCTACAGCCTGAGCAGCACCCTGACACTGAG<br>CAAGGCCGACTACGAGAAGCACAAGGTGTACGCCTGCGAAGTGACCCACCAGGGCCTGTCTAGCCCCGTGACCAAG<br>AGCTTCAACCGGGGCGAGTGT |
| | 2 | 487 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCAGCCAGGTGCAGCTGGTGGAATCT<br>GGCGGCGGAGTGGTGCAGCCTGGCAGAAGCCTGAGACTGAGCTGTGCCGCCAGCGGCTTCACCTTCACCAAGGCCT<br>GGATGCACTGGGTGCGCCAGGCCCCTGGAAAGCAGCTGGAATGGGTGGCCCAGATCAAGGACAAGAGCAACAGCTA<br>CGCCACCTACTACGCCGACAGCGTGAAGGGCCGGTTCACCATCAGCCGGGACGACAGCAAGAACACCCTGTACCTG<br>CAGATGAACAGCCTGCGGGCCGAGGACACCGCCGTGTACTACTGTCGGGGCGTGTACTATGCCCTGAGCCCCTTCGA<br>TTACTGGGGCCAGGGAACCCTCGTGACCGTGTCTAGTCGGACCGCCAGCACAAAGGGCCCATCGGTGTTCCCTCTGG<br>CCCCTTGCAGCAGAAGCACCAGCGAATCTACAGCCGCCCTGGGCTGCCTCGTGAAGGACTACTTTCCCGAGCCCGTG<br>ACCGTGTCCTGGAACTCTGGCGCTCTGACAAGCGGCGTGCACACCTTTCCAGCCGTGCTCCAGAGCAGCGGCCTGTA<br>CTCTCTGAGCAGCGTCGTGACAGTGCCCAGCAGCAGCCTGGGCACCAAGACCTACACCTGTAACGTGGACCACAAGC<br>CCAGCAACACCAAGGTGGACAAGCGGGTGGAATCTAAGTACGGCCCTCCCTGCCCTCCTTGCCCAGCCCCTGAAGCT<br>GCCGGCGGACCCTCCGTGTTCCTGTTCCCCCCAAAGCCCAAGGACACCCTGATGATCAGCCGGACCCCCGAAGTGAC<br>CTGCGTGGTGGTGGATGTGTCCCAGGAAGATCCCGAGGTGCAGTTCAATTGGTACGTGGACGGCGTGGAAGTGCACA<br>ACGCCAAGACCAAGCCCAGAGAGGAACAGTTCAACAGCACCTACCGGGTGGTGTCCGTGCTGACCGTGCTGCACCA<br>GGACTGGCTGAACGGCAAAGAGTACAAGTGCAAGGTGTCCAACAAGGGCCTGCCCAGCTCCATCGAGAAAACCATC<br>AGCAAGGCCAAGGGCCAGCCCCGCGAGCCTCAAGTGTGTACCCTGCCCCCTAGCCAGGAAGAGATGACCAAGAACC<br>AGGTGTCCCTGAGCTGTGCCGTGAAAGGCTTCTACCCCAGCGACATTGCCGTGGAATGGGAGAGCAACGGCCAGCCC<br>GAGAACAACTACAAGACCACCCCCCCTGTGCTGGACAGCGACGGCTCATTCTTCCTGGTGTCCAAGCTGACCGTGGA<br>CAAGAGCCGGTGGCAGGAAGGCAACGTGTTCAGCTGCTCCGTGATGCACGAGGCCCTGCACAACCACTACACCCAG<br>AAGTCCCTGTCTCTGTCCCTGGGC |
| | 3 | 488 | CAAGTGCGGCTGTCTCAGTCTGGCGGCCAGATGAAGAAACCCGGCGACAGCATGCGGATCAGCTGCAGAGCCAGCG<br>GCTACGAGTTCATCAACTGCCCCATCAACTGGATCAGACTGGCCCCTGGCAAGCGGCCTGAGTGGATGGGATGGATG<br>AAGCCCAGACACGGGGCCGTGTCCTACGCCAGACAGCTGCAGGGCAGAGTGACCATGACCCGGGACATGTACAGCG<br>AGACAGCCTTCCTGGAACTGCGGAGCCTGACCAGCGACGATACCGCCGTGTACTTCTGCACCCGGGGCAAGTACTGC<br>ACCGCCAGAGACTACTACAACTGGGACTTCGAGCACTGGGGCCAGGGCACACCTGTGACAGTGTCTAGCGCTTCGAC<br>CAAGGGCCCATCGGTGTTCCCTCTGGCCCCTTGCAGCAGAAGCACCAGCGAATCTACAGCCGCCCTGGGCTGCCTCG<br>TGAAGGACTACTTTCCCGAGCCCGTGACCGTGTCCTGGAACTCTGGCGCTCTGACAAGCGGCGTGCACACCTTTCCA |

TABLE 5-continued

Trispecific binding protein polynucleotide sequences

| Molecule | Polypeptide Number (acc. to formula) | SEQ ID NO | Sequence |
|---|---|---|---|
| | | | GCCGTGCTCCAGAGCAGCGGCCTGTACTCTCTGAGCAGCGTCGTGACAGTGCCCAGCAGCAGCCTGGGCACCAAGACCTACACCTGTAACGTGGACCACAAGCCCAGCAACACCAAGGTGGACAAGCGGGTGGAATCTAAGTACGGCCCTCCCTGCCCTCCTTGCCCAGCCCCTGAAGCTGCCGGCGGACCCTCCGTGTTCCTGTTCCCCCCAAAGCCCAAGGACACCCTGATGATCAGCCGGACCCCCGAAGTGACCTGCGTGGTGGTGGATGTGTCCCAGGAAGATCCCGAGGTGCAGTTCAATTGGTACGTGGACGGCGTGGAAGTGCACAACGCCAAGACCAAGCCCAGAGAGGAACAGTTCAACAGCACCTACCGGGTGGTGTCCGTGCTGACCGTGCTGCACCAGGACTGGCTGAACGGCAAAGAGTACAAGTGCAAGGTGTCCAACAAGGGCCTGCCCAGCTCCATCGAGAAAACCATCAGCAAGGCCAAGGGCCAGCCCCGCGAGCCTCAAGTGTATACCCTGCCCCCTTGCCAGGAAGAGATGACCAAGAACCAGGTGTCCCTGTGGTGTCTCGTGAAAGGCTTCTACCCCAGCGACATTGCCGTGGAATGGGAGAGCAACGGCCAGCCCGAGAACAACTACAAGACCACCCCCCCTGTGCTGGACAGCGACGGCTCATTCTTCCTGTACTCCAAGCTGACCGTGGACAAGAGCCGGTGGCAGGAAGGCAACGTGTTCAGCTGCTCCGTGATGCACGAGGCCCTGCACAACCACTACACCCAGAAGTCCCTGTCTCTGTCCCTGGGC |
| | 4 | 489 | AGCCTGACACAGAGCCCTGGCACCCTGTCACTGAGCCCAGGCGAGACAGCCATCATCAGCTGCCGGACAAGCCAGTACGGCAGCCTGGCCTGGTATCAGCAGAGGCCTGGACAGGCCCCCAGACTCGTGATCTACAGCGGCAGCACAAGAGCCGCCGGAATCCCCGATAGATTCAGCGGCTCCAGATGGGGACCCGACTACAACCTGACCATCAGCAACCTGGAAAGCGGCGACTTCGGCGTGTACTACTGCCAGCAGTACGAGTTCTTCGGCCAGGGCACCAAGGTGCAGGTGGACATCAAGCGTACGGTGGCCGCTCCCAGCGTGTTCATCTTCCCACCTAGCGACGAGCAGCTGAAGTCCGGCACAGCCTCTGTCGTGTGCCTGCTGAACAACTTCTACCCCCGCGAGGCCAAAGTGCAGTGGAAGGTGGACAACGCCCTGCAGAGCGGCAACAGCCAGGAAAGCGTGACCGAGCAGGACAGCAAGGACTCCACCTACAGCCTGAGCAGCACCCTGACACTGAGCAAGGCCGACTACGAGAAGCACAAGGTGTACGCCTGCGAAGTGACCCACCAGGGCCTGTCTAGCCCCGTGACCAAGAGCTTCAACCGGGGCGAGTGT |
| Trispecific 4 VRC07_523/ CD28sup x CD3mid_QQ IgG4 FALA/409K | 1 | 490 | GACATCGTGATGACCCAGACCCCCCTGAGCCTGAGCGTGACACCTGGACAGCCTGCCAGCATCAGCTGCAAGAGCAGCCAGAGCCTGGTGCACCAGAACGCCCAGACCTACCTGAGCTGGTATCTGCAGAAGCCCGGCCAGAGCCCCCAGTCCCTGATCTACAAGGTGTCCAACAGATTCAGCGGCGTGCCCGACAGATTCTCCGGCAGCGGCTCTGGCACCGACTTCACCCTGAAGATCAGCCGGGTGGAAGCCGAGGACGTGGGCGTGTACTATTGTGGCCAGGGCACCCAGTACCCCTTCACCTTTGGCAGCGGCACCAAGGTGGAAATCAAGGGCCAGCCCAAGGCCGCCCCCGACATCCAGATGACCCAGAGCCCCAGCAGCCTGTCTGCCAGCGTGGGCGACAGAGTGACCATCACCTGTCAGGCCAGCCAGAACATCTACGTGTGGCTGAACTGGTATCAGCAGAAGCCCGGCAAGGCCCCCAAGCTGCTGATCTACAAGGCCAGCAACCTGCACACCGGCGTGCCCAGCAGATTTTCTGGCAGCGGCTCCGGCACCGACTTCACCCTGACAATCAGCTCCCTGCAGCCCGAGGACATTGCCACCTACTACTGCCAGCAGGGCCAGACCTACCCCTACACCTTTGGCCAGGGCACCAAGCTGGAAATCAAGACCAAGGGCCCCAGCCGTACGGTGGCCGCTCCCAGCGTGTTCATCTTCCCACCTAGCGACGAGCAGCTGAAGTCCGGCACAGCCTCTGTCGTGTGCCTGCTGAACAACTTCTACCCCCGCGAGGCCAAAGTGCAGTGGAAGGTGGACAACGCCCTGCAGAGCGGCAACAGCCAGGAAAGCGTGACCGAGCAGGACAGCAAGGACTCCACCTACAGCCTGAGCAGCACCCTGACACTGAGCAAGGCCGACTACGAGAAGCACAAGGTGTACGCCTGCGAAGTGACCCACCAGGGCCTGTCTAGCCCCGTGACCAAGAGCTTCAACCGGGGCGAGTGT |
| | 2 | 491 | CAGGTGCAGCTGGTGCAGTCTGGCGCCGAGGTCGTGAAACCTGGCGCCTCTGTGAAGGTGTCCTGCAAGGCCAGCGGCTACACCTTTACCAGCTACTACATCCACTGGGTGCGCCAGGCCCCTGGACAGGGACTGGAATGGATCGGCAGCATCTACCCCGGCAACGTGAACACCAACTACGCCCAGAAGTTCCAGGGCAGAGCCACCCTGACCGTGGACACCAGCATCAGCACCGCCTACATGGAACTGAGCCGGCTGAGAAGCGACGACACCGCCGTGTACTACTGCACCCGGTCCCACTACGGCCTGGATTGGAACTTCGACGTGTGGGGCAAGGGCACCACCGTGACAGTGTCTAGCAGCCAGGTGCAGCTGGTGGAATCTGGCGGCGGAGTGGTGCAGCCTGGCAGAAGCCTGAGACTGAGCTGTGCCGCCAGCGGCTTCACCTTCACCAAGGCCTGGATGCACTGGGTGCGCCAGGCCCCTGGAAAGCAGCTGGAATGGGTGGCCCAGATCAAGGACAAGAGCAACAGCTACGCCACCTACTACGCCGACAGCGTGAAGGGCCGGTTCACCATCAGCCGGGACGACAGCAAGAACACCCTGTACCTGCAGATGAACAGCCTGCGGGCCGAGGACACCGCCGTGTACTACTGTCGGGGCGTGTACTATGCCCTGAGCCCCTTCGA |

TABLE 5-continued

Trispecific binding protein polynucleotide sequences

| Molecule | Polypeptide Number (acc. to formula) | SEQ ID NO | Sequence |
|---|---|---|---|
| | | | TTACTGGGGCCAGGGAACCCTCGTGACCGTGTCTAGTCGGACCGCCAGCACAAAGGGCCCATCGGTGTTCCCTCTGG<br>CCCCTTGCAGCAGAAGCACCAGCGAATCTACAGCCGCCCTGGGCTGCCTCGTGAAGGACTACTTTCCCGAGCCCGTG<br>ACCGTGTCCTGGAACTCTGGCGCTCTGACAAGCGGCGTGCACACCTTTCCAGCCGTGCTCCAGAGCAGCGGCCTGTA<br>CTCTCTGAGCAGCGTCGTGACAGTGCCCAGCAGCAGCCTGGGCACCAAGACCTACACCTGTAACGTGGACCACAAGC<br>CCAGCAACACCAAGGTGGACAAGCGGGTGGAATCTAAGTACGGCCCTCCCTGCCCTCCTTGCCCAGCCCCTGAAGCT<br>GCCGGCGGACCCTCCGTGTTCCTGTTCCCCCCAAAGCCCAAGGACACCCTGATGATCAGCCGGACCCCCGAAGTGAC<br>CTGCGTGGTGGTGGATGTGTCCCAGGAAGATCCCGAGGTGCAGTTCAATTGGTACGTGGACGGCGTGGAAGTGCACA<br>ACGCCAAGACCAAGCCCAGAGAGGAACAGTTCAACAGCACCTACCGGGTGGTGTCCGTGCTGACCGTGCTGCACCA<br>GGACTGGCTGAACGGCAAAGAGTACAAGTGCAAGGTGTCCAACAAGGGCCTGCCCAGCTCCATCGAGAAAACCATC<br>AGCAAGGCCAAGGGCCAGCCCCGCGAGCCTCAAGTGTGTACCCTGCCCCCTAGCCAGGAAGAGATGACCAAGAACC<br>AGGTGTCCCTGAGCTGTGCCGTGAAAGGCTTCTACCCCAGCGACATTGCCGTGGAATGGGAGAGCAACGGCCAGCCC<br>GAGAACAACTACAAGACCACCCCCCCTGTGCTGGACAGCGACGGCTCATTCTTCCTGGTGTCCAAGCTGACCGTGGA<br>CAAGAGCCGGTGGCAGGAAGGCAACGTGTTCAGCTGCTCCGTGATGCACGAGGCCCTGCACAACCACTACACCCAG<br>AAGTCCCTGTCTCTGTCCCTGGGC |
| | 3 | 492 | CAAGTGCGGCTGTCTCAGTCTGGCGGCCAGATGAAGAAACCCGGCGACAGCATGCGGATCAGCTGCAGAGCCAGCG<br>GCTACGAGTTCATCAACTGCCCCATCAACTGGATCAGACTGGCCCCTGGCAAGCGGCCTGAGTGGATGGGATGGATG<br>AAGCCCAGACACGGGGCCGTGTCCTACGCCAGACAGCTGCAGGGCAGAGTGACCATGACCCGGGACATGTACAGCG<br>AGACAGCCTTCCTGGAACTGCGGAGCCTGACCAGCGACGATACCGCCGTGTACTTCTGCACCCGGGGCAAGTACTGC<br>ACCGCCAGAGACTACTACAACTGGGACTTCGAGCACTGGGGCCAGGGCACACCTGTGACAGTGTCTAGCGCTTCGAC<br>CAAGGGCCCATCGGTGTTCCCTCTGGCCCCTTGCAGCAGAAGCACCAGCGAATCTACAGCCGCCCTGGGCTGCCTCG<br>TGAAGGACTACTTTCCCGAGCCCGTGACCGTGTCCTGGAACTCTGGCGCTCTGACAAGCGGCGTGCACACCTTTCCA<br>GCCGTGCTCCAGAGCAGCGGCCTGTACTCTCTGAGCAGCGTCGTGACAGTGCCCAGCAGCAGCCTGGGCACCAAGAC<br>CTACACCTGTAACGTGGACCACAAGCCCAGCAACACCAAGGTGGACAAGCGGGTGGAATCTAAGTACGGCCCTCCC<br>TGCCCTCCTTGCCCAGCCCCTGAAGCTGCCGGCGGACCCTCCGTGTTCCTGTTCCCCCCAAAGCCCAAGGACACCCTG<br>ATGATCAGCCGGACCCCCGAAGTGACCTGCGTGGTGGTGGATGTGTCCCAGGAAGATCCCGAGGTGCAGTTCAATTG<br>GTACGTGGACGGCGTGGAAGTGCACAACGCCAAGACCAAGCCCAGAGAGGAACAGTTCAACAGCACCTACCGGGTG<br>GTGTCCGTGCTGACCGTGCTGCACCAGGACTGGCTGAACGGCAAAGAGTACAAGTGCAAGGTGTCCAACAAGGGCC<br>TGCCCAGCTCCATCGAGAAAACCATCAGCAAGGCCAAGGGCCAGCCCCGCGAGCCTCAAGTGTATACCCTGCCCCCT<br>TGCCAGGAAGAGATGACCAAGAACCAGGTGTCCCTGTGGTGTCTCGTGAAAGGCTTCTACCCCAGCGACATTGCCGT<br>GGAATGGGAGAGCAACGGCCAGCCCGAGAACAACTACAAGACCACCCCCCCTGTGCTGGACAGCGACGGCTCATTC<br>TTCCTGTACTCCAAGCTGACCGTGGACAAGAGCCGGTGGCAGGAAGGCAACGTGTTCAGCTGCTCCGTGATGCACGA<br>GGCCCTGCACAACCACTACACCCAGAAGTCCCTGTCTCTGTCCCTGGGC |
| | 4 | 493 | AGCCTGACACAGAGCCCTGGCACCCTGTCACTGAGCCCAGGCGAGACAGCCATCATCAGCTGCCGGACAAGCCAGT<br>ACGGCAGCCTGGCCTGGTATCAGCAGAGGCCTGGACAGGCCCCCAGACTCGTGATCTACAGCGGCAGCACAAGAGC<br>CGCCGGAATCCCCGATAGATTCAGCGGCTCCAGATGGGGACCCGACTACAACCTGACCATCAGCAACCTGGAAAGC<br>GGCGACTTCGGCGTGTACTACTGCCAGCAGTACGAGTTCTTCGGCCAGGGCACCAAGGTGCAGGTGGACATCAAGCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| Trispecific 6 VRC07_523/ | 1 | 494 | GACATCGTGATGACCCAGACCCCCCTGAGCCTGAGCGTGACACCTGGACAGCCTGCCAGCATCAGCTGCAAGAGCA<br>GCCAGAGCCTGGTGCACCAGAACGCCCAGACCTACCTGAGCTGGTATCTGCAGAAGCCCGGCCAGAGCCCCCAGTC |

TABLE 5-continued

| Trispecific binding protein polynucleotide sequences | | | |
|---|---|---|---|
| Molecule | Polypeptide Number (acc. to formula) | SEQ ID NO | Sequence |
| CD28sup x CD3mid_QQ IgG4 FALA/409K_ DKTHT linker | | | CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 495 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC<br>CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC<br>GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 496 | CAAGTGCGGCTGTCTCAGTCTGGCGGCCAGATGAAGAAACCCGGCGACAGCATGCGGATCAGCTGCAGAGCCAGCG<br>GCTACGAGTTCATCAACTGCCCCATCAACTGGATCAGACTGGCCCCTGGCAAGCGGCCTGAGTGGATGGGATGGATG<br>AAGCCCAGACACGGGGCCGTGTCCTACGCCAGACAGCTGCAGGGCAGAGTGACCATGACCCGGGACATGTACAGCG<br>AGACAGCCTTCCTGGAACTGCGGAGCCTGACCAGCGACGATACCGCCGTGTACTTCTGCACCCGGGGCAAGTACTGC<br>ACCGCCAGAGACTACTACAACTGGGACTTCGAGCACTGGGGCCAGGGCACACCTGTGACAGTGTCTAGCGCTTCGAC<br>CAAGGGCCCATCGGTGTTCCCTCTGGCCCCTTGCAGCAGAAGCACCAGCGAATCTACAGCCGCCCTGGGCTGCCTCG<br>TGAAGGACTACTTTCCCGAGCCCGTGACCGTGTCCTGGAACTCTGGCGCTCTGACAAGCGGCGTGCACACCTTTCCA<br>GCCGTGCTCCAGAGCAGCGGCCTGTACTCTCTGAGCAGCGTCGTGACAGTGCCCAGCAGCAGCCTGGGCACCAAGAC<br>CTACACCTGTAACGTGGACCACAAGCCCAGCAACACCAAGGTGGACAAGCGGGTGGAATCTAAGTACGGCCCTCCC |

TABLE 5-continued

Trispecific binding protein polynucleotide sequences

| Molecule | Polypeptide Number (acc. to formula) | SEQ ID NO | Sequence |
|---|---|---|---|
| | | | TGCCCTCCTTGCCCAGCCCCTGAAGCTGCCGGCGGACCCTCCGTGTTCCTGTTCCCCCCAAAGCCCAAGGACACCCTG<br>ATGATCAGCCGGACCCCCGAAGTGACCTGCGTGGTGGTGGATGTGTCCCAGGAAGATCCCGAGGTGCAGTTCAATTG<br>GTACGTGGACGGCGTGGAAGTGCACAACGCCAAGACCAAGCCCAGAGAGGAACAGTTCAACAGCACCTACCGGGTG<br>GTGTCCGTGCTGACCGTGCTGCACCAGGACTGGCTGAACGGCAAAGAGTACAAGTGCAAGGTGTCCAACAAGGGCC<br>TGCCCAGCTCCATCGAGAAAACCATCAGCAAGGCCAAGGGCCAGCCCCGCGAGCCTCAAGTGTATACCCTGCCCCCT<br>TGCCAGGAAGAGATGACCAAGAACCAGGTGTCCCTGTGGTGTCTCGTGAAAGGCTTCTACCCCAGCGACATTGCCGT<br>GGAATGGGAGAGCAACGGCCAGCCCGAGAACAACTACAAGACCACCCCCCCTGTGCTGGACAGCGACGGCTCATTC<br>TTCCTGTACTCCAAGCTGACCGTGGACAAGAGCCGGTGGCAGGAAGGCAACGTGTTCAGCTGCTCCGTGATGCACGA<br>GGCCCTGCACAACCACTACACCCAGAAGTCCCTGTCTCTGTCCCTGGGC |
| | 4 | 497 | AGCCTGACACAGAGCCCTGGCACCCTGTCACTGAGCCCAGGCGAGACAGCCATCATCAGCTGCCGGACAAGCCAGT<br>ACGGCAGCCTGGCCTGGTATCAGCAGAGGCCTGGACAGGCCCCCAGACTCGTGATCTACAGCGGCAGCACAAGAGC<br>CGCCGGAATCCCCGATAGATTCAGCGGCTCCAGATGGGGACCCGACTACAACCTGACCATCAGCAACCTGGAAAGC<br>GGCGACTTCGGCGTGTACTACTGCCAGCAGTACGAGTTCTTCGGCCAGGGCACCAAGGTGCAGGTGGACATCAAGCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| Trispecific 8<br><br>VRC07_23/<br>CD28sup x<br>CD3mid_QQ<br>IgG1_NNAS/<br>409K_DKTHT<br>linker | 1 | 498 | GACATCGTGATGACCCAGACCCCCCTGAGCCTGAGCGTGACACCTGGACAGCCTGCCAGCATCAGCTGCAAGAGCA<br><br>GCCAGAGCCTGGTGCACCAGAACGCCCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 499 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCCAGCGTGTTCCCTCTGGCCCCTAGCAGCAAGAGCACATCTGGCGGAACAGCCGCCCTGGGCTGCCTCGTGAAG |

TABLE 5-continued

Trispecific binding protein polynucleotide sequences

| Molecule | Polypeptide Number (acc. to formula) | SEQ ID NO | Sequence |
|---|---|---|---|
| | | | GACTACTTTCCCGAGCCCGTGACCGTGTCCTGGAATTCTGGCGCCCTGACCAGCGGCGTGCACACCTTTCCAGCTGTG CTGCAGTCCAGCGGCCTGTACAGCCTGAGCAGCGTCGTGACAGTGCCCAGCAGCTCTCTGGGCACCCAGACCTACAT CTGCAACGTGAACCACAAGCCCAGCAACACCAAGGTGGACAAGAAGGTGGAACCCAAGAGCTGCGACAAGACCCA CACCTGTCCCCCTTGTCCTGCCCCCGAACTGCTGGGAGGCCCTTCCGTGTTCCTGTTCCCCCCAAAGCCCAAGGACAC CCTGATGATCAGCCGGACCCCCGAAGTGACCTGCGTGGTGGTGGATGTGTCCCACGAGGACCCTGAAGTGAAGTTCA ATTGGTACGTGGACGGCGTGGAAGTGCACAACGCCAAGACCAAGCCAAGAGAGGAACAGTACAACAATGCCTCCCG GGTGGTGTCCGTGCTGACCGTGCTGCACCAGGACTGGCTGAACGGCAAAGAGTACAAGTGCAAGGTGTCCAACAAG GCCCTGCCTGCCCCCATCGAGAAAACCATCAGCAAGGCCAAGGGCCAGCCCCGCGAACCCCAGGTGTGCACACTGC CCCCAAGCAGGGACGAGCTGACCAAGAACCAGGTGTCCCTGAGCTGTGCCGTGAAAGGCTTCTACCCCTCCGATATC GCCGTGGAATGGGAGAGCAACGGCCAGCCCGAGAACAACTACAAGACCACCCCCCCTGTGCTGGACAGCGACGGCT CATTCTTCCTGGTGTCCAAGCTGACAGTGGACAAGTCCCGGTGGCAGCAGGGCAACGTGTTCAGCTGCTCCGTGATG CACGAGGCCCTGCACAACCACTACACCCAGAAGTCCCTGAGCCTGAGCCCCGGC |
| | 3 | 500 | CAAGTGCGGCTGTCTCAGTCTGGCGGCCAGATGAAGAAACCCGGCGACAGCATGCGGATCAGCTGCAGAGCCAGCG GCTACGAGTTCATCAACTGCCCCATCAACTGGATCAGACTGGCCCCTGGCAAGCGGCCTGAGTGGATGGGATGGATG AAGCCCAGACACGGGGCCGTGTCCTACGCCAGACAGCTGCAGGGCAGAGTGACCATGACCCGGGACATGTACAGCG AGACAGCCTTCCTGGAACTGCGGAGCCTGACCAGCGACGATACCGCCGTGTACTTCTGCACCCGGGGCAAGTACTGC ACCGCCAGAGACTACTACAACTGGGACTTCGAGCACTGGGGCCAGGGCACACCTGTGACAGTGTCTAGCGCTTCGAC CAAGGGCCCATCGGTCTTCCCCCTGGCACCCTCCTCCAAGAGCACCTCTGGGGGCACAGCGGCCCTGGGCTGCCTGG TCAAGGACTACTTCCCCGAACCGGTGACGGTGTCGTGGAACTCAGGCGCCCTGACCAGCGGCGTGCACACCTTCCCG GCTGTCCTACAGTCCTCAGGACTCTACTCCCTCAGCAGCGTGGTGACCGTGCCCTCCAGCAGCTTGGGCACCCAGAC CTACATCTGCAACGTGAATCACAAGCCCAGCAACACCAAGGTGGACAAGAAAGTTGAGCCCAAATCTTGTGACAAA ACTCACACATGCCCACCGTGCCCAGCACCTGAACTCCTGGGGGGACCGTCAGTCTTCCTCTTCCCCCCAAAACCCAA GGACACCCTCATGATCTCCCGGACCCCTGAGGTCACATGCGTGGTGGTGGACGTGAGCCACGAAGACCCTGAGGTCA AGTTCAACTGGTATGTTGACGGCGTGGAGGTGCATAATGCCAAGACAAAGCCGCGGGAGGAGCAGTACAACAATGC CTCCCGTGTGGTCAGCGTCCTCACCGTCCTGCACCAGGACTGGCTGAATGGCAAGGAGTACAAGTGCAAGGTCTCCA ACAAAGCCCTCCCAGCCCCCATCGAGAAAACCATCTCCAAAGCCAAAGGGCAGCCCCGAGAACCACAGGTGTACAC CCTGCCCCCATGCCGGGATGAGCTGACCAAGAATCAAGTCAGCCTGTGGTGCCTGGTAAAAGGCTTCTATCCCAGCG ACATCGCCGTGGAGTGGGAGAGCAATGGGCAGCCGGAGAACAACTACAAGACCACGCCTCCCGTGCTGGACTCCGA CGGCTCCTTCTTCCTCTATTCAAAACTCACCGTGGACAAGAGCAGGTGGCAGCAGGGGAACGTCTTCTCATGCTCCGT GCTGCATGAGGCTCTGCACAGCCACTACACGCAGAAGAGCCTCTCCCTGTCTCCGGGT |
| | 4 | 501 | AGCCTGACACAGAGCCCTGGCACCCTGTCACTGAGCCCAGGCGAGACAGCCATCATCAGCTGCCGGACAAGCCAGT ACGGCAGCCTGGCCTGGTATCAGCAGAGGCCTGGACAGGCCCCCAGACTCGTGATCTACAGCGGCAGCACAAGAGC CGCCGGAATCCCCGATAGATTCAGCGGCTCCAGATGGGGACCCGACTACAACCTGACCATCAGCAACCTGGAAAGC GGCGACTTCGGCGTGTACTACTGCCAGCAGTACGAGTTCTTCGGCCAGGGCACCAAGGTGCAGGTGGACATCAAGCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| Trispecific 9 VRC07_523_ FR3-03/ CD28sup x | 1 | 502 | GACATCGTGATGACCCAGACCCCCCTGAGCCTGAGCGTGACACCTGGACAGCCTGCCAGCATCAGCTGCAAGAGCA GCCAGAGCCTGGTGCACGAGAACCTGCAGACCTACCTGAGCTGGTATCTGCAGAAGCCCGGCCAGAGCCCCCAGTC CCTGATCTACAAGGTGTCCAACAGATTCAGCGGCGTGCCCGACAGATTCTCCGGCAGCGGCTCTGGCACCGACTTCA CCCTGAAGATCAGCCGGGTGGAAGCCGAGGACGTGGGCGTGTACTATTGTGGCCAGGGCACCCAGTACCCCTTCACC |

TABLE 5-continued

| Molecule | Polypeptide Number (acc. to formula) | SEQ ID NO | Sequence |
|---|---|---|---|
| Trispecific binding protein polynucleotide sequences | | | |
| CD3mid_ ENLQ IgG4 FALA/409K_ DKTHT linker | | | TTTGGCAGCGGCACCAAGGTGGAAATCAAGGACAAAACCCATACCGACATCCAGATGACCCAGAGCCCCAGCAGCC TGTCTGCCAGCGTGGGCGACAGAGTGACCATCACCTGTCAGGCCAGCCAGAACATCTACGTGTGGCTGAACTGGTAT CAGCAGAAGCCCGGCAAGGCCCCCAAGCTGCTGATCTACAAGGCCAGCAACCTGCACACCGGCGTGCCCAGCAGAT TTTCTGGCAGCGGCTCCGGCACCGACTTCACCCTGACAATCAGCTCCCTGCAGCCCGAGGACATTGCCACCTACTACT GCCAGCAGGGCCAGACCTACCCCTACACCTTTGGCCAGGGCACCAAGCTGGAAATCAAGGATAAGACCCACACCCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| | 2 | 503 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAAC ACCCTGTACCTGCAGATGAACAGCCTGCGGGCCGAGGACACCGCCGTGTACTACTGTCGGGGCGTGTACTATGCCCT GAGCCCCTTCGATTACTGGGGCCAGGGAACCCTCGTGACCGTGTCTAGTGATAAGACCCACACCGCCAGCACAAAGG GCCCATCGGTGTTCCCTCTGGCCCCTTGCAGCAGAAGCACCAGCGAATCTACAGCCGCCCTGGGCTGCCTCGTGAAG GACTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTACAC CTGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGATC AGCCGGACCCCCGAAGTGACCTGCGTGGTGGTGGATGTGTCCCAGGAAGATCCCGAGGTGCAGTTCAATTGGTACGT GGACGGCGTGGAAGTGCACAACGCCAAGACCAAGCCCAGAGAGGAACAGTTCAACAGCACCTACCGGGTGGTGTCC GTGCTGACCGTGCTGCACCAGGACTGGCTGAACGGCAAAGAGTACAAGTGCAAGGTGTCCAACAAGGGCCTGCCCA GCTCCATCGAGAAAACCATCAGCAAGGCCAAGGGCCAGCCCCGCGAGCCTCAAGTGTGTACCCTGCCCCCTAGCCA GGAAGAGATGACCAAGAACCAGGTGTCCCTGAGCTGTGCCGTGAAAGGCTTCTACCCCAGCGACATTGCCGTGGAA TGGGAGAGCAACGGCCAGCCCGAGAACAACTACAAGACCACCCCCCCTGTGCTGGACAGCGACGGCTCATTCTTCCT GGTGTCCAAGCTGACCGTGGACAAGAGCCGGTGGCAGGAAGGCAACGTGTTCAGCTGCTCCGTGATGCACGAGGCC CTGCACAACCACTACACCCAGAAGTCCCTGTCTCTGTCCCTGGGC |
| | 3 | 504 | CAAGTGCGGCTGTCTCAGTCTGGCGGCCAGATGAAGAAACCCGGCGACAGCATGCGGATCAGCTGCAGAGCCAGCG GCTACGAGTTCATCAACTGCCCCATCAACTGGATCAGACTGGCCCCTGGCAAGCGGCCTGAGTGGATGGGATGGATG AAGCCCAGACACGGGGCCGTGTCCTACGCCAGACAGCTGCAGGGCAGAGTGACCATGACCCGGCAGCTGAGCCAGG ACCCTGATGATCCGGATTGGGGCACAGCCTTCCTGGAACTGCGGAGCCTGACCAGCGACGATACCGCCGTGTACTTC TGCACCCGGGGCAAGTACTGCACCGCCAGAGACTACTACAACTGGGACTTCGAGCACTGGGGCCAGGGCACACCTG TGACAGTGTCTAGCGCTTCGACCAAGGGCCCATCGGTGTTCCCTCTGGCCCCTTGCAGCAGAAGCACCAGCGAATCT ACAGCCGCCCTGGGCTGCCTCGTGAAGGACTACTTTCCCGAGCCCGTGACCGTGTCCTGGAACTCTGGCGCTCTGAC AAGCGGCGTGCACACCTTTCCAGCCGTGCTCCAGAGCAGCGGCCTGTACTCTCTGAGCAGCGTCGTGACAGTGCCCA GCAGCAGCCTGGGCACCAAGACCTACACCTGTAACGTGGACCACAAGCCCAGCAACACCAAGGTGGACAAGCGGGT GGAATCTAAGTACGGCCCTCCCTGCCCTCCTTGCCCAGCCCCTGAAGCTGCCGGCGGACCCTCCGTGTTCCTGTTCCC CCCAAAGCCCAAGGACACCCTGATGATCAGCCGGACCCCCGAAGTGACCTGCGTGGTGGTGGATGTGTCCCAGGAA |

TABLE 5-continued

Trispecific binding protein polynucleotide sequences

| Molecule | Polypeptide Number (acc. to formula) | SEQ ID NO | Sequence |
|---|---|---|---|
| | | | GATCCCGAGGTGCAGTTCAATTGGTACGTGGACGGCGTGGAAGTGCACAACGCCAAGACCAAGCCCAGAGAGGAAC<br>AGTTCAACAGCACCTACCGGGTGGTGTCCGTGCTGACCGTGCTGCACCAGGACTGGCTGAACGGCAAAGAGTACAA<br>GTGCAAGGTGTCCAACAAGGGCCTGCCCAGCTCCATCGAGAAAACCATCAGCAAGGCCAAGGGCCAGCCCCGCGAG<br>CCTCAAGTGTATACCCTGCCCCCTTGCCAGGAAGAGATGACCAAGAACCAGGTGTCCCTGTGGTGTCTCGTGAAAGG<br>CTTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGTACTCCAAGCTGACCGTGGACAAGAGCCGGTGGCAGGAAGGCAACGT<br>GTTCAGCTGCTCCGTGATGCACGAGGCCCTGCACAACCACTACACCCAGAAGTCCCTGTCTCTGTCCCTGGGC |
| | 4 | 505 | AGCCTGACACAGAGCCCTGGCACCCTGTCACTGAGCCCAGGCGAGACAGCCATCATCAGCTGCCGGACAAGCCAGT<br>ACGGCAGCCTGGCCTGGTATCAGCAGAGGCCTGGACAGGCCCCCAGACTCGTGATCTACAGCGGCAGCACAAGAGC<br>CGCCGGAATCCCCGATAGATTCAGCGGCTCCAGATGGGGACCCGACTACAACCTGACCATCAGCAACCTGGAAAGC<br>GGCGACTTCGGCGTGTACTACTGCCAGCAGTACGAGTTCTTCGGCCAGGGCACCAAGGTGCAGGTGGACATCAAGCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| Trispecific 10<br>VRC07_523_<br>FR3-03/<br>CD28sup x<br>CD3mid_<br>ENLF IgG4<br>FALA/409K_<br>DKTHT linker | 1 | 506 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGTTCACCTACCTGAGCTGGTATCTGCAGAAGCCCGGCCAGAGCCCCCAGTCC<br>CTGATCTACAAGGTGTCCAACAGATTCAGCGGCGTGCCCGACAGATTCTCCGGCAGCGGCTCTGGCACCGACTTCAC<br>CCTGAAGATCAGCCGGGTGGAAGCCGAGGACGTGGGCGTGTACTATTGTGGCCAGGGCACCCAGTACCCCTTCACCT<br>TTGGCAGCGGCACCAAGGTGGAAATCAAGGACAAAACCCATACCGACATCCAGATGACCCAGAGCCCCAGCAGCCT<br>GTCTGCCAGCGTGGGCGACAGAGTGACCATCACCTGTCAGGCCAGCCAGAACATCTACGTGTGGCTGAACTGGTATC<br>AGCAGAAGCCCGGCAAGGCCCCCAAGCTGCTGATCTACAAGGCCAGCAACCTGCACACCGGCGTGCCCAGCAGATT<br>TTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 507 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC |

TABLE 5-continued

| Trispecific binding protein polynucleotide sequences | | | |
|---|---|---|---|
| Molecule | Polypeptide Number (acc. to formula) | SEQ ID NO | Sequence |
| | | | CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC<br>GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 508 | CAAGTGCGGCTGTCTCAGTCTGGCGGCCAGATGAAGAAACCCGGCGACAGCATGCGGATCAGCTGCAGAGCCAGCG<br>GCTACGAGTTCATCAACTGCCCCATCAACTGGATCAGACTGGCCCCTGGCAAGCGGCCTGAGTGGATGGGATGGATG<br>AAGCCCAGACACGGGGCCGTGTCCTACGCCAGACAGCTGCAGGGCAGAGTGACCATGACCCGGCAGCTGAGCCAGG<br>ACCCTGATGATCCGGATTGGGGCACAGCCTTCCTGGAACTGCGGAGCCTGACCAGCGACGATACCGCCGTGTACTTC<br>TGCACCCGGGGCAAGTACTGCACCGCCAGAGACTACTACAACTGGGACTTCGAGCACTGGGGCCAGGGCACACCTG<br>TGACAGTGTCTAGCGCTTCGACCAAGGGCCCATCGGTGTTCCCTCTGGCCCCTTGCAGCAGAAGCACCAGCGAATCT<br>ACAGCCGCCCTGGGCTGCCTCGTGAAGGACTACTTTCCCGAGCCCGTGACCGTGTCCTGGAACTCTGGCGCTCTGAC<br>AAGCGGCGTGCACACCTTTCCAGCCGTGCTCCAGAGCAGCGGCCTGTACTCTCTGAGCAGCGTCGTGACAGTGCCCA<br>GCAGCAGCCTGGGCACCAAGACCTACACCTGTAACGTGGACCACAAGCCCAGCAACACCAAGGTGGACAAGCGGGT<br>GGAATCTAAGTACGGCCCTCCCTGCCCTCCTTGCCCAGCCCCTGAAGCTGCCGGCGGACCCTCCGTGTTCCTGTTCCC<br>CCCAAAGCCCAAGGACACCCTGATGATCAGCCGGACCCCCGAAGTGACCTGCGTGGTGGTGGATGTGTCCCAGGAA<br>GATCCCGAGGTGCAGTTCAATTGGTACGTGGACGGCGTGGAAGTGCACAACGCCAAGACCAAGCCCAGAGAGGAAC<br>AGTTCAACAGCACCTACCGGGTGGTGTCCGTGCTGACCGTGCTGCACCAGGACTGGCTGAACGGCAAAGAGTACAA<br>GTGCAAGGTGTCCAACAAGGGCCTGCCCAGCTCCATCGAGAAAACCATCAGCAAGGCCAAGGGCCAGCCCCGCGAG<br>CCTCAAGTGTATACCCTGCCCCCTTGCCAGGAAGAGATGACCAAGAACCAGGTGTCCCTGTGGTGTCTCGTGAAAGG<br>CTTCTACCCCAGCGACATTGCCGTGGAATGGGAGAGCAACGGCCAGCCCGAGAACAACTACAAGACCACCCCCCCT<br>GTGCTGGACAGCGACGGCTCATTCTTCCTGTACTCCAAGCTGACCGTGGACAAGAGCCGGTGGCAGGAAGGCAACGT<br>GTTCAGCTGCTCCGTGATGCACGAGGCCCTGCACAACCACTACACCCAGAAGTCCCTGTCTCTGTCCCTGGGC |
| | 4 | 509 | AGCCTGACACAGAGCCCTGGCACCCTGTCACTGAGCCCAGGCGAGACAGCCATCATCAGCTGCCGGACAAGCCAGT<br>ACGGCAGCCTGGCCTGGTATCAGCAGAGGCCTGGACAGGCCCCCAGACTCGTGATCTACAGCGGCAGCACAAGAGC<br>CGCCGGAATCCCCGATAGATTCAGCGGCTCCAGATGGGGACCCGACTACAACCTGACCATCAGCAACCTGGAAAGC<br>GGCGACTTCGGCGTGTACTACTGCCAGCAGTACGAGTTCTTCGGCCAGGGCACCAAGGTGCAGGTGGACATCAAGCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| Trispecific 11<br>VRC07_523_<br>FR3-03/<br>CD28sup x<br>CD3mid_<br>ENLQ | 1 | 510 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT |

TABLE 5-continued

| Trispecific binding protein polynucleotide sequences | | | |
|---|---|---|---|
| Molecule | Polypeptide Number (acc. to formula) | SEQ ID NO | Sequence |
| IgG1_NNAS_ DKTHT linker | | | CAGCAGAAGCCCGGCAAGGCCCCCAAGCTGCTGATCTACAAGGCCAGCAACCTGCACACCGGCGTGCCCAGCAGAT TTTCTGGCAGCGGCTCCGGCACCGACTTCACCCTGACAATCAGCTCCCTGCAGCCCGAGGACATTGCCACCTACTACT GCCAGCAGGGCCAGACCTACCCCTACACCTTTGGCCAGGGCACCAAGCTGGAAATCAAGGATAAGACCCACACCCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| | 2 | 511 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAAC ACCCTGTACCTGCAGATGAACAGCCTGCGGGCCGAGGACACCGCCGTGTACTACTGTCGGGGCGTGTACTATGCCCT GAGCCCCTTCGATTACTGGGGCCAGGGAACCCTCGTGACCGTGTCTAGTGATAAGACCCACACCGCCAGCACAAAGG GCCCCAGCGTGTTCCCTCTGGCCCCTAGCAGCAAGAGCACATCTGGCGGAACAGCCGCCCTGGGCTGCCTCGTGAAG GACTACTTTCCCGAGCCCGTGACCGTGTCCTGGAATTCTGGCGCCCTGACCAGCGGCGTGCACACCTTTCCAGCTGTG CTGCAGTCCAGCGGCCTGTACAGCCTGAGCAGCGTCGTGACAGTGCCCAGCAGCTCTCTGGGCACCCAGACCTACAT CTGCAACGTGAACCACAAGCCCAGCAACACCAAGGTGGACAAGAAGGTGGAACCCAAGAGCTGCGACAAGACCCA CACCTGTCCCCCTTGTCCTGCCCCCGAACTGCTGGGAGGCCCTTCCGTGTTCCTGTTCCCCCCAAAGCCCAAGGACAC CCTGATGATCAGCCGGACCCCCGAAGTGACCTGCGTGGTGGTGGATGTGTCCCACGAGGACCCTGAAGTGAAGTTCA ATTGGTACGTGGACGGCGTGGAAGTGCACAACGCCAAGACCAAGCCAAGAGAGGAACAGTACAACAATGCCTCCCG GGTGGTGTCCGTGCTGACCGTGCTGCACCAGGACTGGCTGAACGGCAAAGAGTACAAGTGCAAGGTGTCCAACAAG GCCCTGCCTGCCCCCATCGAGAAAACCATCAGCAAGGCCAAGGGCCAGCCCCGCGAACCCCAGGTGTGCACACTGC CCCCAAGCAGGGACGAGCTGACCAAGAACCAGGTGTCCCTGAGCTGTGCCGTGAAAGGCTTCTACCCCTCCGATATC GCCGTGGAATGGGAGAGCAACGGCCAGCCCGAGAACAACTACAAGACCACCCCCCCTGTGCTGGACAGCGACGGCT CATTCTTCCTGGTGTCCAAGCTGACAGTGGACAAGTCCCGGTGGCAGCAGGGCAACGTGTTCAGCTGCTCCGTGATG CACGAGGCCCTGCACAACCACTACACCCAGAAGTCCCTGAGCCTGAGCCCCGGC |
| | 3 | 512 | CAAGTGCGGCTGTCTCAGTCTGGCGGCCAGATGAAGAAACCCGGCGACAGCATGCGGATCAGCTGCAGAGCCAGCG GCTACGAGTTCATCAACTGCCCCATCAACTGGATCAGACTGGCCCCTGGCAAGCGGCCTGAGTGGATGGGATGGATG AAGCCCAGACACGGGGCCGTGTCCTACGCCAGACAGCTGCAGGGCAGAGTGACCATGACCCGGCAGCTGAGCCAGG ACCCTGATGATCCGGATTGGGGCACAGCCTTCCTGGAACTGCGGAGCCTGACCAGCGACGATACCGCCGTGTACTTC TGCACCCGGGGCAAGTACTGCACCGCCAGAGACTACTACAACTGGGACTTCGAGCACTGGGGCCAGGGCACACCTG TGACAGTGTCTAGCGCTTCGACCAAGGGCCCATCGGTCTTCCCCCTGGCACCCTCCTCCAAGAGCACCTCTGGGGGC ACAGCGGCCCTGGGCTGCCTGGTCAAGGACTACTTCCCCGAACCGGTGACGGTGTCGTGGAACTCAGGCGCCCTGAC CAGCGGCGTGCACACCTTCCCGGCTGTCCTACAGTCCTCAGGACTCTACTCCCTCAGCAGCGTGGTGACCGTGCCCTC CAGCAGCTTGGGCACCCAGACCTACATCTGCAACGTGAATCACAAGCCCAGCAACACCAAGGTGGACAAGAAAGTT GAGCCCAAATCTTGTGACAAAACTCACACATGCCCACCGTGCCCAGCACCTGAACTCCTGGGGGGACCGTCAGTCTT CCTCTTCCCCCCAAAACCCAAGGACACCCTCATGATCTCCCGGACCCCTGAGGTCACATGCGTGGTGGTGGACGTGA GCCACGAAGACCCTGAGGTCAAGTTCAACTGGTATGTTGACGGCGTGGAGGTGCATAATGCCAAGACAAAGCCGCG GGAGGAGCAGTACAACAATGCCTCCCGTGTGGTCAGCGTCCTCACCGTCCTGCACCAGGACTGGCTGAATGGCAAGG |

TABLE 5-continued

Trispecific binding protein polynucleotide sequences

| Molecule | Polypeptide Number (acc. to formula) | SEQ ID NO | Sequence |
|---|---|---|---|
| | | | AGTACAAGTGCAAGGTCTCCAACAAAGCCCTCCCAGCCCCCATCGAGAAAACCATCTCCAAAGCCAAAGGGCAGCC<br>CCGAGAACCACAGGTGTACACCCTGCCCCCATGCCGGGATGAGCTGACCAAGAATCAAGTCAGCCTGTGGTGCCTGG<br>TAAAAGGCTTCTATCCCAGCGACATCGCCGTGGAGTGGGAGAGCAATGGGCAGCCGGAGAACAACTACAAGACCAC<br>GCCTCCCGTGCTGGACTCCGACGGCTCCTTCTTCCTCTACTCAAAACTCACCGTGGACAAGAGCAGGTGGCAGCAGG<br>GGAACGTCTTCTCATGCTCCGTGATGCATGAGGCTCTGCACAACCACTACACGCAGAAGAGCCTCTCCCTGTCTCCG<br>GGT |
| | 4 | 513 | AGCCTGACACAGAGCCCTGGCACCCTGTCACTGAGCCCAGGCGAGACAGCCATCATCAGCTGCCGGACAAGCCAGT<br>ACGGCAGCCTGGCCTGGTATCAGCAGAGGCCTGGACAGGCCCCCAGACTCGTGATCTACAGCGGCAGCACAAGAGC<br>CGCCGGAATCCCCGATAGATTCAGCGGCTCCAGATGGGGACCCGACTACAACCTGACCATCAGCAACCTGGAAAGC<br>GGCGACTTCGGCGTGTACTACTGCCAGCAGTACGAGTTCTTCGGCCAGGGCACCAAGGTGCAGGTGGACATCAAGCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| Trispecific 12<br>VRC07_523_<br>FR3-03/<br>CD28sup x<br>CD3mid_<br>ENLF<br>IgG1_NNAS_<br>DKTHT linker | 1 | 514 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGTTCACCTACCTGAGCTGGTATCTGCAGAAGCCCGGCCAGAGCCCCCAGTCC<br>CTGATCTACAAGGTGTCCAACAGATTCAGCGGCGTGCCCGACAGATTCTCCGGCAGCGGCTCTGGCACCGACTTCAC<br>CCTGAAGATCAGCCGGGTGGAAGCCGAGGACGTGGGCGTGTACTATTGTGGCCAGGGCACCCAGTACCCCTTCACCT<br>TTGGCAGCGGCACCAAGGTGGAAATCAAGGACAAAACCCATACCGACATCCAGATGACCCAGAGCCCCAGCAGCCT<br>GTCTGCCAGCGTGGGCGACAGAGTGACCATCACCTGTCAGGCCAGCCAGAACATCTACGTGTGGCTGAACTGGTATC<br>AGCAGAAGCCCGGCAAGGCCCCCAAGCTGCTGATCTACAAGGCCAGCAACCTGCACACCGGCGTGCCCAGCAGATT<br>TTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 515 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCCAGCGTGTTCCCTCTGGCCCCTAGCAGCAAGAGCACATCTGGCGGAACAGCCGCCCTGGGCTGCCTCGTGAAG<br>GACTACTTTCCCGAGCCCGTGACCGTGTCCTGGAATTCTGGCGCCCTGACCAGCGGCGTGCACACCTTTCCAGCTGTG<br>CTGCAGTCCAGCGGCCTGTACAGCCTGAGCAGCGTCGTGACAGTGCCCAGCAGCTCTCTGGGCACCCAGACCTACAT<br>CTGCAACGTGAACCACAAGCCCAGCAACACCAAGGTGGACAAGAAGGTGGAACCCAAGAGCTGCGACAAGACCCA |

TABLE 5-continued

Trispecific binding protein polynucleotide sequences

| Molecule | Polypeptide Number (acc. to formula) | SEQ ID NO | Sequence |
|---|---|---|---|
| | | | CACCTGTCCCCCTTGTCCTGCCCCCGAACTGCTGGGAGGCCCTTCCGTGTTCCTGTTCCCCCCAAAGCCCAAGGACAC CCTGATGATCAGCCGGACCCCCGAAGTGACCTGCGTGGTGGTGGATGTGTCCCACGAGGACCCTGAAGTGAAGTTCA ATTGGTACGTGGACGGCGTGGAAGTGCACAACGCCAAGACCAAGCCAAGAGAGGAACAGTACAACAATGCCTCCCG GGTGGTGTCCGTGCTGACCGTGCTGCACCAGGACTGGCTGAACGGCAAAGAGTACAAGTGCAAGGTGTCCAACAAG GCCCTGCCTGCCCCCATCGAGAAAACCATCAGCAAGGCCAAGGGCCAGCCCCGCGAACCCCAGGTGTGCACACTGC CCCCAAGCAGGGACGAGCTGACCAAGAACCAGGTGTCCCTGAGCTGTGCCGTGAAAGGCTTCTACCCCTCCGATATC GCCGTGGAATGGGAGAGCAACGGCCAGCCCGAGAACAACTACAAGACCACCCCCCCTGTGCTGGACAGCGACGGCT CATTCTTCCTGGTGTCCAAGCTGACAGTGGACAAGTCCCGGTGGCAGCAGGGCAACGTGTTCAGCTGCTCCGTGATG CACGAGGCCCTGCACAACCACTACACCCAGAAGTCCCTGAGCCTGAGCCCCGGC |
| | 3 | 516 | CAAGTGCGGCTGTCTCAGTCTGGCGGCCAGATGAAGAAACCCGGCGACAGCATGCGGATCAGCTGCAGAGCCAGCG GCTACGAGTTCATCAACTGCCCCATCAACTGGATCAGACTGGCCCCTGGCAAGCGGCCTGAGTGGATGGGATGGATG AAGCCCAGACACGGGGCCGTGTCCTACGCCAGACAGCTGCAGGGCAGAGTGACCATGACCCGGCAGCTGAGCCAGG ACCCTGATGATCCGGATTGGGGCACAGCCTTCCTGGAACTGCGGAGCCTGACCAGCGACGATACCGCCGTGTACTTC TGCACCCGGGGCAAGTACTGCACCGCCAGAGACTACTACAACTGGGACTTCGAGCACTGGGGCCAGGGCACACCTG TGACAGTGTCTAGCGCTTCGACCAAGGGCCCATCGGTCTTCCCCCTGGCACCCTCCTCCAAGAGCACCTCTGGGGGC ACAGCGGCCCTGGGCTGCCTGGTCAAGGACTACTTCCCCGAACCGGTGACGGTGTCGTGGAACTCAGGCGCCCTGAC CAGCGGCGTGCACACCTTCCCGGCTGTCCTACAGTCCTCAGGACTCTACTCCCTCAGCAGCGTGGTGACCGTGCCCTC CAGCAGCTTGGGCACCCAGACCTACATCTGCAACGTGAATCACAAGCCCAGCAACACCAAGGTGGACAAGAAAGTT GAGCCCAAATCTTGTGACAAAACTCACACATGCCCACCGTGCCCAGCACCTGAACTCCTGGGGGGACCGTCAGTCTT CCTCTTCCCCCCAAAACCCAAGGACACCCTCATGATCTCCCGGACCCCTGAGGTCACATGCGTGGTGGTGGACGTGA GCCACGAAGACCCTGAGGTCAAGTTCAACTGGTATGTTGACGGCGTGGAGGTGCATAATGCCAAGACAAAGCCGCG GGAGGAGCAGTACAACAATGCCTCCCGTGTGGTCAGCGTCCTCACCGTCCTGCACCAGGACTGGCTGAATGGCAAGG AGTACAAGTGCAAGGTCTCCAACAAAGCCCTCCCAGCCCCCATCGAGAAAACCATCTCCAAAGCCAAAGGGCAGCC CCGAGAACCACAGGTGTACACCCTGCCCCCATGCCGGGATGAGCTGACCAAGAATCAAGTCAGCCTGTGGTGCCTGG TAAAAGGCTTCTATCCCAGCGACATCGCCGTGGAGTGGGAGAGCAATGGGCAGCCGGAGAACAACTACAAGACCAC GCCTCCCGTGCTGGACTCCGACGGCTCCTTCTTCCTCTACTCAAAACTCACCGTGGACAAGAGCAGGTGGCAGCAGG GGAACGTCTTCTCATGCTCCGTGATGCATGAGGCTCTGCACAACCACTACACGCAGAAGAGCCTCTCCCTGTCTCCG GGT |
| | 4 | 517 | AGCCTGACACAGAGCCCTGGCACCCTGTCACTGAGCCCAGGCGAGACAGCCATCATCAGCTGCCGGACAAGCCAGT ACGGCAGCCTGGCCTGGTATCAGCAGAGGCCTGGACAGGCCCCCAGACTCGTGATCTACAGCGGCAGCACAAGAGC CGCCGGAATCCCCGATAGATTCAGCGGCTCCAGATGGGGACCCGACTACAACCTGACCATCAGCAACCTGGAAAGC GGCGACTTCGGCGTGTACTACTGCCAGCAGTACGAGTTCTTCGGCCAGGGCACCAAGGTGCAGGTGGACATCAAGCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| Trispecific 13 N6/CD28sup x CD3mid IgG4 | 1 | 518 | GACATCGTGATGACCCAGACCCCCCTGAGCCTGAGCGTGACACCTGGACAGCCTGCCAGCATCAGCTGCAAGAGCA GCCAGAGCCTGGTGCACAACAACGCCAACACCTACCTGAGCTGGTATCTGCAGAAGCCCGGCCAGAGCCCCCAGTC CCTGATCTACAAGGTGTCCAACAGATTCAGCGGCGTGCCCGACAGATTCTCCGGCAGCGGCTCTGGCACCGACTTCA CCCTGAAGATCAGCCGGGTGGAAGCCGAGGACGTGGGCGTGTACTATTGTGGCCAGGGCACCCAGTACCCCTTCACC TTTGGCAGCGGCACCAAGGTGGAAATCAAGGGCCAGCCCAAGGCCGCCCCCGACATCCAGATGACCCAGAGCCCCA GCAGCCTGTCTGCCAGCGTGGGCGACAGAGTGACCATCACCTGTCAGGCCAGCCAGAACATCTACGTGTGGCTGAAC |

TABLE 5-continued

Trispecific binding protein polynucleotide sequences

| Molecule | Polypeptide Number (acc. to formula) | SEQ ID NO | Sequence |
|---|---|---|---|
| | | | TGGTATCAGCAGAAGCCCGGCAAGGCCCCCAAGCTGCTGATCTACAAGGCCAGCAACCTGCACACCGGCGTGCCCA<br>GCAGATTTTCTGGCAGCGGCTCCGGCACCGACTTCACCCTGACAATCAGCTCCCTGCAGCCCGAGGACATTGCCACC<br>TACTACTGCCAGCAGGGCCAGACCTACCCCTACACCTTTGGCCAGGGCACCAAGCTGGAAATCAAGACCAAGGGCC<br>CCAGCCGTACGGTGGCCGCTCCCAGCGTGTTCATCTTCCCACCTAGCGACGAGCAGCTGAAGTCCGGCACAGCCTCT<br>GTCGTGTGCCTGCTGAACAACTTCTACCCCCGCGAGGCCAAAGTGCAGTGGAAGGTGGACAACGCCCTGCAGAGCG<br>GCAACAGCCAGGAAAGCGTGACCGAGCAGGACAGCAAGGACTCCACCTACAGCCTGAGCAGCACCCTGACACTGAG<br>CAAGGCCGACTACGAGAAGCACAAGGTGTACGCCTGCGAAGTGACCCACCAGGGCCTGTCTAGCCCCGTGACCAAG<br>AGCTTCAACCGGGGCGAGTGT |
| | 2 | 519 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCAGCCAGGTGCAGCTGGTGGAATCT<br>GGCGGCGGAGTGGTGCAGCCTGGCAGAAGCCTGAGACTGAGCTGTGCCGCCAGCGGCTTCACCTTCACCAAGGCCT<br>GGATGCACTGGGTGCGCCAGGCCCCTGGAAAGCAGCTGGAATGGGTGGCCCAGATCAAGGACAAGAGCAACAGCTA<br>CGCCACCTACTACGCCGACAGCGTGAAGGGCCGGTTCACCATCAGCCGGGACGACAGCAAGAACACCCTGTACCTG<br>CAGATGAACAGCCTGCGGGCCGAGGACACCGCCGTGTACTACTGTCGGGGCGTGTACTATGCCCTGAGCCCCTTCGA<br>TTACTGGGGCCAGGGAACCCTCGTGACCGTGTCTAGTCGGACCGCCAGCACAAAGGGCCCATCGGTGTTCCCTCTGG<br>CCCCTTGCAGCAGAAGCACCAGCGAATCTACAGCCGCCCTGGGCTGCCTCGTGAAGGACTACTTTCCCGAGCCCGTG<br>ACCGTGTCCTGGAACTCTGGCGCTCTGACAAGCGGCGTGCACACCTTTCCAGCCGTGCTCCAGAGCAGCGGCCTGTA<br>CTCTCTGAGCAGCGTCGTGACAGTGCCCAGCAGCAGCCTGGGCACCAAGACCTACACCTGTAACGTGGACCACAAGC<br>CCAGCAACACCAAGGTGGACAAGCGGGTGGAATCTAAGTACGGCCCTCCCTGCCCTCCTTGCCCAGCCCCTCCTGTG<br>GCTGGACCCTCCGTGTTCCTGTTCCCCCCAAAGCCCAAGGACACCCTGATGATCAGCCGGACCCCCGAAGTGACCTG<br>CGTGGTGGTGGATGTGTCCCAGGAAGATCCCGAGGTGCAGTTCAATTGGTACGTGGACGGCGTGGAAGTGCACAAC<br>GCCAAGACCAAGCCCAGAGAGGAACAGTTCAACAGCACCTACCGGGTGGTGTCCGTGCTGACCGTGCTGCACCAGG<br>ACTGGCTGAACGGCAAAGAGTACAAGTGCAAGGTGTCCAACAAGGGCCTGCCCAGCTCCATCGAGAAAACCATCAG<br>CAAGGCCAAGGGCCAGCCCCGCGAGCCTCAAGTGTGTACCCTGCCCCCTAGCCAGGAAGAGATGACCAAGAACCAG<br>GTGTCCCTGAGCTGTGCCGTGAAAGGCTTCTACCCCAGCGACATTGCCGTGGAATGGGAGAGCAACGGCCAGCCCGA<br>GAACAACTACAAGACCACCCCCCCTGTGCTGGACAGCGACGGCTCATTCTTCCTGGTGTCCAAGCTGACCGTGGACA<br>AGAGCCGGTGGCAGGAAGGCAACGTGTTCAGCTGCTCCGTGATGCACGAGGCCCTGCACAACCACTACACCCAGAA<br>GTCCCTGTCTCTGTCCCTGGGC |
| | 3 | 520 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTGTTCCCTCTGGCCCCTTGCAGCAGAAGCACCAGCGAATCTACAGCCGCCCTGGGCTGCCTCGTGAAGGAC<br>TACTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACCTG<br>TAACGTGGACCACAAGCCCAGCAACACCAAGGTGGACAAGCGGGTGGAATCTAAGTACGGCCCTCCCTGCCCTCCTT<br>GCCCAGCCCCTCCTGTGGCTGGACCCTCCGTGTTCCTGTTCCCCCCAAAGCCCAAGGACACCCTGATGATCAGCCGG<br>ACCCCCGAAGTGACCTGCGTGGTGGTGGATGTGTCCCAGGAAGATCCCGAGGTGCAGTTCAATTGGTACGTGGACGG<br>CGTGGAAGTGCACAACGCCAAGACCAAGCCCAGAGAGGAACAGTTCAACAGCACCTACCGGGTGGTGTCCGTGCTG<br>ACCGTGCTGCACCAGGACTGGCTGAACGGCAAAGAGTACAAGTGCAAGGTGTCCAACAAGGGCCTGCCCAGCTCCA |

TABLE 5-continued

| Trispecific binding protein polynucleotide sequences | | | |
|---|---|---|---|
| Molecule | Polypeptide Number (acc. to formula) | SEQ ID NO | Sequence |
| | | | TCGAGAAAACCATCAGCAAGGCCAAGGGCCAGCCCCGCGAGCCTCAAGTGTATACCCTGCCCCCTTGCCAGGAAGA<br>GATGACCAAGAACCAGGTGTCCCTGTGGTGTCTCGTGAAAGGCTTCTACCCCAGCGACATTGCCGTGGAATGGGAGA<br>GCAACGGCCAGCCCGAGAACAACTACAAGACCACCCCCCCTGTGCTGGACAGCGACGGCTCATTCTTCCTGTACTCC<br>AAGCTGACCGTGGACAAGAGCCGGTGGCAGGAAGGCAACGTGTTCAGCTGCTCCGTGATGCACGAGGCCCTGCACA<br>ACCACTACACCCAGAAGTCCCTGTCTCTGTCCCTGGGC |
| | 4 | 521 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 14 N6/CD28sup x CD3mid IgG4 | 1 | 522 | GACATCGTGATGACCCAGACCCCCCTGAGCCTGAGCGTGACACCTGGACAGCCTGCCAGCATCAGCTGCAAGAGCA<br>GCCAGAGCCTGGTGCACAACAACGCCAACACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGGCCAGCCCAAGGCCGCCCCCGACATCCAGATGACCCAGAGCCCCA<br>GCAGCCTGTCTGCCAGCGTGGGCGACAGAGTGACCATCACCTGTCAGGCCAGCCAGAACATCTACGTGTGGCTGAAC<br>TGGTATCAGCAGAAGCCCGGCAAGGCCCCCAAGCTGCTGATCTACAAGGCCAGCAACCTGCACACCGGCGTGCCCA<br>GCAGATTTTCTGGCAGCGGCTCCGGCACCGACTTCACCCTGACAATCAGCTCCCTGCAGCCCGAGGACATTGCCACC<br>TACTACTGCCAGCAGGGCCAGACCTACCCCTACACCTTTGGCCAGGGCACCAAGCTGGAAATCAAGACCAAGGGCC<br>CCAGCCGTACGGTGGCCGCTCCCAGCGTGTTCATCTTCCCACCTAGCGACGAGCAGCTGAAGTCCGGCACAGCCTCT<br>GTCGTGTGCCTGCTGAACAACTTCTACCCCCGCGAGGCCAAAGTGCAGTGGAAGGTGGACAACGCCCTGCAGAGCG<br>GCAACAGCCAGGAAAGCGTGACCGAGCAGGACAGCAAGGACTCCACCTACAGCCTGAGCAGCACCCTGACACTGAG<br>CAAGGCCGACTACGAGAAGCACAAGGTGTACGCCTGCGAAGTGACCCACCAGGGCCTGTCTAGCCCCGTGACCAAG<br>AGCTTCAACCGGGGCGAGTGT |
| | 2 | 523 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCAGCCAGGTGCAGCTGGTGGAATCT<br>GGCGGCGGAGTGGTGCAGCCTGGCAGAAGCCTGAGACTGAGCTGTGCCGCCAGCGGCTTCACCTTCACCAAGGCCT<br>GGATGCACTGGGTGCGCCAGGCCCCTGGAAAGCAGCTGGAATGGGTGGCCCAGATCAAGGACAAGAGCAACAGCTA<br>CGCCACCTACTACGCCGACAGCGTGAAGGGCCGGTTCACCATCAGCCGGGACGACAGCAAGAACACCCTGTACCTG<br>CAGATGAACAGCCTGCGGGCCGAGGACACCGCCGTGTACTACTGTCGGGGCGTGTACTATGCCCTGAGCCCCTTCGA<br>TTACTGGGGCCAGGGAACCCTCGTGACCGTGTCTAGTCGGACCGCCAGCACAAAGGGCCCATCGGTGTTCCCTCTGG<br>CCCCTTGCAGCAGAAGCACCAGCGAATCTACAGCCGCCCTGGGCTGCCTCGTGAAGGACTACTTTCCCGAGCCCGTG<br>ACCGTGTCCTGGAACTCTGGCGCTCTGACAAGCGGCGTGCACACCTTTCCAGCCGTGCTCCAGAGCAGCGGCCTGTA<br>CTCTCTGAGCAGCGTCGTGACAGTGCCCAGCAGCAGCCTGGGCACCAAGACCTACACCTGTAACGTGGACCACAAGC<br>CCAGCAACACCAAGGTGGACAAGCGGGTGGAATCTAAGTACGGCCCTCCCTGCCCTCCTTGCCCAGCCCCTGAAGCT<br>GCCGGCGGACCCTCCGTGTTCCTGTTCCCCCCAAAGCCCAAGGACACCCTGATGATCAGCCGGACCCCCGAAGTGAC |

TABLE 5-continued

Trispecific binding protein polynucleotide sequences

| Molecule | Polypeptide Number (acc. to formula) | SEQ ID NO | Sequence |
|---|---|---|---|
| | | | CTGCGTGGTGGTGGATGTGTCCCAGGAAGATCCCGAGGTGCAGTTCAATTGGTACGTGGACGGCGTGGAAGTGCACA ACGCCAAGACCAAGCCCAGAGAGGAACAGTTCAACAGCACCTACCGGGTGGTGTCCGTGCTGACCGTGCTGCACCA GGACTGGCTGAACGGCAAAGAGTACAAGTGCAAGGTGTCCAACAAGGGCCTGCCCAGCTCCATCGAGAAAACCATC AGCAAGGCCAAGGGCCAGCCCCGCGAGCCTCAAGTGTGTACCCTGCCCCCTAGCCAGGAAGAGATGACCAAGAACC AGGTGTCCCTGAGCTGTGCCGTGAAAGGCTTCTACCCCAGCGACATTGCCGTGGAATGGGAGAGCAACGGCCAGCCC GAGAACAACTACAAGACCACCCCCCCTGTGCTGGACAGCGACGGCTCATTCTTCCTGGTGTCCAAGCTGACCGTGGA CAAGAGCCGGTGGCAGGAAGGCAACGTGTTCAGCTGCTCCGTGATGCACGAGGCCCTGCACAACCACTACACCCAG AAGTCCCTGTCTCTGTCCCTGGGC |
| | 3 | 524 | AGAGCCCACCTGGTGCAGTCTGGCACCGCCATGAAGAAACCAGGCGCCTCTGTGCGGGTGTCCTGTCAGACAAGCG GCTACACCTTCACCGCCCACATCCTGTTCTGGTTCCGGCAGGCCCCTGGCAGAGGACTGGAATGGGTGGGATGGATC AAGCCCCAGTATGGCGCCGTGAACTTCGGCGGAGGCTTCCGGGATAGAGTGACCCTGACCCGGGACGTGTACCGCG AGATCGCCTACATGGACATCCGGGGCCTGAAGCCCGATGACACCGCCGTGTACTACTGCGCCAGAGACAGAAGCTA CGGCGACAGCAGCTGGGCTCTGGATGCTTGGGGCCAGGGCACAACCGTGGTGGTGTCTGCCGCCTCTACAAAGGGCC CATCGGTGTTCCCTCTGGCCCCTTGCAGCAGAAGCACCAGCGAATCTACAGCCGCCNTGGGCTGCCTCGTGAAGGAC TACTTTCCCGAGCCCGTGACCGTGTCCTGGAACTCTGGCGCTCTGACAAGCGGCGTGCACACCTTTCCAGCCGTGCTC CAGAGCAGCGGCCTGTACTCTCTGAGCAGCGTCGTGACAGTGCCCAGCAGCAGCCTGGGCACCAAGACCTACACCTG TAACGTGGACCACAAGCCCAGCAACACCAAGGTGGACAAGCGGGTGGAATCTAAGTACGGCCCTCCCTGCCCTCCTT GCCCAGCCCCTGAAGCTGCCGGCGGACCCTCCGTGTTCCTGTTCCCCCCAAAGCCCAAGGACACCCTGATGATCAGC CGGACCCCCGAAGTGACCTGCGTGGTGGTGGATGTGTCCCAGGAAGATCCCGAGGTGCAGTTCAATTGGTACGTGGA CGGCGTGGAAGTGCACAACGCCAAGACCAAGCCCAGAGAGGAACAGTTCAACAGCACCTACCGGGTGGTGTCCGTG CTGACCGTGCTGCACCAGGACTGGCTGAACGGCAAAGAGTACAAGTGCAAGGTGTCCAACAAGGGCCTGCCCAGCT CCATCGAGAAAACCATCAGCAAGGCCAAGGGCCAGCCCCGCGAGCCTCAAGTGTATACCCTGCCCCCTTGCCAGGA AGAGATGACCAAGAACCAGGTGTCCCTGTGGTGTCTCGTGAAAGGCTTCTACCCCAGCGACATTGCCGTGGAATGGG AGAGCAACGGCCAGCCCGAGAACAACTACAAGACCACCCCCCCTGTGCTGGACAGCGACGGCTCATTCTTCCTGTAC TCCAAGCTGACCGTGGACAAGAGCCGGTGGCAGGAAGGCAACGTGTTCAGCTGCTCCGTGATGCACGAGGCCCTGC ACAACCACTACACCCAGAAGTCCCTGTCTCTGTCCCTGGGC |
| | 4 | 525 | TACATCCACGTGACCCAGAGCCCCAGCAGCCTGTCCGTGTCCATCGGCGACAGAGTGACCATCAACTGCCAGACCTC TCAGGGCGTGGGCAGCGACCTGCACTGGTATCAGCACAAGCCTGGCAGAGCCCCCAAGCTGCTGATCCACCACACA AGCAGCGTGGAAGATGGCGTGCCCAGCAGATTTTCCGGCAGCGGCTTCCACACCAGCTTCAACCTGACCATCAGCGA TCTGCAGGCCGACGACATTGCCACCTACTATTGTCAGGTGCTGCAGTTCTTCGGCAGAGGCAGCAGACTGCACATCA AGCGTACGGTGGCCGCTCCCAGCGTGTTCATCTTCCCACCTAGCGACGAGCAGCTGAAGTCCGGCACAGCCTCTGTC GTGTGCCTGCTGAACAACTTCTACCCCCGCGAGGCCAAAGTGCAGTGGAAGGTGGACAACGCCCTGCAGAGCGGCA ACAGCCAGGAAAGCGTGACCGAGCAGGACAGCAAGGACTCCACCTACAGCCTGAGCAGCACCCTGACACTGAGCAA GGCCGACTACGAGAAGCACAAGGTGTACGCCTGCGAAGTGACCCACCAGGGCCTGTCTAGCCCCGTGACCAAGAGC TTCAACCGGGGCGAGTGT |
| Trispecific 15 N6/CD28sup x CD3mid_QQ IgG4 FALA/409K | 1 | 526 | GACATCGTGATGACCCAGACCCCCCTGAGCCTGAGCGTGACACCTGGACAGCCTGCCAGCATCAGCTGCAAGAGCA GCCAGAGCCTGGTGCACAACAACGCCAACACCTACCTGAGCTGGTATCTGCAGAAGCCCGGCCAGAGCCCCCAGTC CCTGATCTACAAGGTGTCCAACAGATTCAGCGGCGTGCCCGACAGATTCTCCGGCAGCGGCTCTGGCACCGACTTCA CCCTGAAGATCAGCCGGGTGGAAGCCGAGGACGTGGGCGTGTACTATTGTGGCCAGGGCACCCAGTACCCCTTCACC TTTGGCAGCGGCACCAAGGTGGAAATCAAGGGCCAGCCCAAGGCCGCCCCCGACATCCAGATGACCCAGAGCCCCA GCAGCCTGTCTGCCAGCGTGGGCGACAGAGTGACCATCACCTGTCAGGCCAGCCAGAACATCTACGTGTGGCTGAAC TGGTATCAGCAGAAGCCCGGCAAGGCCCCCAAGCTGCTGATCTACAAGGCCAGCAACCTGCACACCGGCGTGCCCA GCAGATTTTCTGGCAGCGGCTCCGGCACCGACTTCACCCTGACAATCAGCTCCCTGCAGCCCGAGGACATTGCCACC |

TABLE 5-continued

Trispecific binding protein polynucleotide sequences

| Molecule | Polypeptide Number (acc. to formula) | SEQ ID NO | Sequence |
|---|---|---|---|
| | | | TACTACTGCCAGCAGGGCCAGACCTACCCCTACACCTTTGGCCAGGGCACCAAGCTGGAAATCAAGACCAAGGGCC<br>CCAGCCGTACGGTGGCCGCTCCCAGCGTGTTCATCTTCCCACCTAGCGACGAGCAGCTGAAGTCCGGCACAGCCTCT<br>GTCGTGTGCCTGCTGAACAACTTCTACCCCCGCGAGGCCAAAGTGCAGTGGAAGGTGGACAACGCCCTGCAGAGCG<br>GCAACAGCCAGGAAAGCGTGACCGAGCAGGACAGCAAGGACTCCACCTACAGCCTGAGCAGCACCCTGACACTGAG<br>CAAGGCCGACTACGAGAAGCACAAGGTGTACGCCTGCGAAGTGACCCACCAGGGCCTGTCTAGCCCCGTGACCAAG<br>AGCTTCAACCGGGGCGAGTGT |
| | 2 | 527 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCAGCCAGGTGCAGCTGGTGGAATCT<br>GGCGGCGGAGTGGTGCAGCCTGGCAGAAGCCTGAGACTGAGCTGTGCCGCCAGCGGCTTCACCTTCACCAAGGCCT<br>GGATGCACTGGGTGCGCCAGGCCCCTGGAAAGCAGCTGGAATGGGTGGCCCAGATCAAGGACAAGAGCAACAGCTA<br>CGCCACCTACTACGCCGACAGCGTGAAGGGCCGGTTCACCATCAGCCGGGACGACAGCAAGAACACCCTGTACCTG<br>CAGATGAACAGCCTGCGGGCCGAGGACACCGCCGTGTACTACTGTCGGGGCGTGTACTATGCCCTGAGCCCCTTCGA<br>TTACTGGGGCCAGGGAACCCTCGTGACCGTGTCTAGTCGGACCGCCAGCACAAAGGGCCCATCGGTGTTCCCTCTGG<br>CCCCTTGCAGCAGAAGCACCAGCGAATCTACAGCCGCCCTGGGCTGCCTCGTGAAGGACTACTTTCCCGAGCCCGTG<br>ACCGTGTCCTGGAACTCTGGCGCTCTGACAAGCGGCGTGCACACCTTTCCAGCCGTGCTCCAGAGCAGCGGCCTGTA<br>CTCTCTGAGCAGCGTCGTGACAGTGCCCAGCAGCAGCCTGGGCACCAAGACCTACACCTGTAACGTGGACCACAAGC<br>CCAGCAACACCAAGGTGGACAAGCGGGTGGAATCTAAGTACGGCCCTCCCTGCCCTCCTTGCCCAGCCCCTGAAGCT<br>GCCGGCGGACCCTCCGTGTTCCTGTTCCCCCCAAAGCCCAAGGACACCCTGATGATCAGCCGGACCCCCGAAGTGAC<br>CTGCGTGGTGGTGGATGTGTCCCAGGAAGATCCCGAGGTGCAGTTCAATTGGTACGTGGACGGCGTGGAAGTGCACA<br>ACGCCAAGACCAAGCCCAGAGAGGAACAGTTCAACAGCACCTACCGGGTGGTGTCCGTGCTGACCGTGCTGCACCA<br>GGACTGGCTGAACGGCAAAGAGTACAAGTGCAAGGTGTCCAACAAGGGCCTGCCCAGCTCCATCGAGAAAACCATC<br>AGCAAGGCCAAGGGCCAGCCCCGCGAGCCTCAAGTGTGTACCCTGCCCCCTAGCCAGGAAGAGATGACCAAGAACC<br>AGGTGTCCCTGAGCTGTGCCGTGAAAGGCTTCTACCCCAGCGACATTGCCGTGGAATGGGAGAGCAACGGCCAGCCC<br>GAGAACAACTACAAGACCACCCCCCCTGTGCTGGACAGCGACGGCTCATTCTTCCTGGTGTCCAAGCTGACCGTGGA<br>CAAGAGCCGGTGGCAGGAAGGCAACGTGTTCAGCTGCTCCGTGATGCACGAGGCCCTGCACAACCACTACACCCAG<br>AAGTCCCTGTCTCTGTCCCTGGGC |
| | 3 | 528 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTGTTCCCTCTGGCCCCTTGCAGCAGAAGCACCAGCGAATCTACAGCCGCCNTGGGCTGCCTCGTGAAGGAC<br>TACTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACCTG<br>TAACGTGGACCACAAGCCCAGCAACACCAAGGTGGACAAGCGGGTGGAATCTAAGTACGGCCCTCCCTGCCCTCCTT<br>GCCCAGCCCCTGAAGCTGCCGGCGGACCCTCCGTGTTCCTGTTCCCCCCAAAGCCCAAGGACACCCTGATGATCAGC<br>CGGACCCCCGAAGTGACCTGCGTGGTGGTGGATGTGTCCCAGGAAGATCCCGAGGTGCAGTTCAATTGGTACGTGGA<br>CGGCGTGGAAGTGCACAACGCCAAGACCAAGCCCAGAGAGGAACAGTTCAACAGCACCTACCGGGTGGTGTCCGTG<br>CTGACCGTGCTGCACCAGGACTGGCTGAACGGCAAAGAGTACAAGTGCAAGGTGTCCAACAAGGGCCTGCCCAGCT<br>CCATCGAGAAAACCATCAGCAAGGCCAAGGGCCAGCCCCGCGAGCCTCAAGTGTATACCCTGCCCCCTTGCCAGGA<br>AGAGATGACCAAGAACCAGGTGTCCCTGTGGTGTCTCGTGAAAGGCTTCTACCCCAGCGACATTGCCGTGGAATGGG |

TABLE 5-continued

Trispecific binding protein polynucleotide sequences

| Molecule | Polypeptide Number (acc. to formula) | SEQ ID NO | Sequence |
|---|---|---|---|
| | | | AGAGCAACGGCCAGCCCGAGAACAACTACAAGACCACCCCCCCTGTGCTGGACAGCGACGGCTCATTCTTCCTGTAC<br>TCCAAGCTGACCGTGGACAAGAGCCGGTGGCAGGAAGGCAACGTGTTCAGCTGCTCCGTGATGCACGAGGCCCTGC<br>ACAACCACTACACCCAGAAGTCCCTGTCTCTGTCCCTGGGC |
| | 4 | 529 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 16 N6/CD28sup x CD3mid_QQ IgG4 FALA/409K_ DKTHT linker | 1 | 530 | GACATCGTGATGACCCAGACCCCCCTGAGCCTGAGCGTGACACCTGGACAGCCTGCCAGCATCAGCTGCAAGAGCA<br>GCCAGAGCCTGGTGCACCAGAACGCCCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 531 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC<br>CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC |

TABLE 5-continued

Trispecific binding protein polynucleotide sequences

| Molecule | Polypeptide Number (acc. to formula) | SEQ ID NO | Sequence |
|---|---|---|---|
| | | | GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 532 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTGTTCCCTCTGGCCCCTTGCAGCAGAAGCACCAGCGAATCTACAGCCGCCNTGGGCTGCCTCGTGAAGGAC<br>TACTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACCTG<br>TAACGTGGACCACAAGCCCAGCAACACCAAGGTGGACAAGCGGGTGGAATCTAAGTACGGCCCTCCCTGCCCTCCTT<br>GCCCAGCCCCTGAAGCTGCCGGCGGACCCTCCGTGTTCCTGTTCCCCCCAAAGCCCAAGGACACCCTGATGATCAGC<br>CGGACCCCCGAAGTGACCTGCGTGGTGGTGGATGTGTCCCAGGAAGATCCCGAGGTGCAGTTCAATTGGTACGTGGA<br>CGGCGTGGAAGTGCACAACGCCAAGACCAAGCCCAGAGAGGAACAGTTCAACAGCACCTACCGGGTGGTGTCCGTG<br>CTGACCGTGCTGCACCAGGACTGGCTGAACGGCAAAGAGTACAAGTGCAAGGTGTCCAACAAGGGCCTGCCCAGCT<br>CCATCGAGAAAACCATCAGCAAGGCCAAGGGCCAGCCCCGCGAGCCTCAAGTGTATACCCTGCCCCCTTGCCAGGA<br>AGAGATGACCAAGAACCAGGTGTCCCTGTGGTGTCTCGTGAAAGGCTTCTACCCCAGCGACATTGCCGTGGAATGGG<br>AGAGCAACGGCCAGCCCGAGAACAACTACAAGACCACCCCCCCTGTGCTGGACAGCGACGGCTCATTCTTCCTGTAC<br>TCCAAGCTGACCGTGGACAAGAGCCGGTGGCAGGAAGGCAACGTGTTCAGCTGCTCCGTGATGCACGAGGCCCTGC<br>ACAACCACTACACCCAGAAGTCCCTGTCTCTGTCCCTGGGC |
| | 4 | 533 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 17<br>N6/CD28sup<br>x CD3mid<br>IgG4<br>FALA/409K_<br>DKTHT linker | 1 | 534 | GACATCGTGATGACCCAGACCCCCCTGAGCCTGAGCGTGACACCTGGACAGCCTGCCAGCATCAGCTGCAAGAGCA<br>GCCAGAGCCTGGTGCACAACAACGCCAACACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCAG<br>TCAGCCCAAGGCTGCCCCCTCGGTCACTCTGTTCCCGCCCTCGAGTGAGGAGCTTCAAGCCAACAAGGCCACACTGG |

TABLE 5-continued

Trispecific binding protein polynucleotide sequences

| Molecule | Polypeptide Number (acc. to formula) | SEQ ID NO | Sequence |
| --- | --- | --- | --- |
| | | | TGTGTCTCATAAGTGACTTCTACCCGGGAGCCGTGACAGTGGCCTGGAAGGCAGATAGCAGCCCCGTCAAGGCGGG<br>AGTGGAGACCACCACACCCTCCAAACAAAGCAACAACAAGTACGCGGCCAGCAGCTACCTGAGCCTGACGCCTGAG<br>CAGTGGAAGTCCCACAGAAGCTACAGCTGCCAGGTCACGCATGAAGGGAGCACCGTGGAGAAGACAGTGGCCCCTA<br>CAGAATGT |
| | 2 | 535 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC<br>CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC<br>GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 536 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTGTTCCCTCTGGCCCCTTGCAGCAGAAGCACCAGCGAATCTACAGCCGCCNTGGGCTGCCTCGTGAAGGAC<br>TACTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACCTG<br>TAACGTGGACCACAAGCCCAGCAACACCAAGGTGGACAAGCGGGTGGAATCTAAGTACGGCCCTCCCTGCCCTCCTT<br>GCCCAGCCCCTGAAGCTGCCGGCGGACCCTCCGTGTTCCTGTTCCCCCCAAAGCCCAAGGACACCCTGATGATCAGC<br>CGGACCCCCGAAGTGACCTGCGTGGTGGTGGATGTGTCCCAGGAAGATCCCGAGGTGCAGTTCAATTGGTACGTGGA<br>CGGCGTGGAAGTGCACAACGCCAAGACCAAGCCCAGAGAGGAACAGTTCAACAGCACCTACCGGGTGGTGTCCGTG<br>CTGACCGTGCTGCACCAGGACTGGCTGAACGGCAAAGAGTACAAGTGCAAGGTGTCCAACAAGGGCCTGCCCAGCT<br>CCATCGAGAAAACCATCAGCAAGGCCAAGGGCCAGCCCCGCGAGCCTCAAGTGTATACCCTGCCCCCTTGCCAGGA<br>AGAGATGACCAAGAACCAGGTGTCCCTGTGGTGTCTCGTGAAAGGCTTCTACCCCAGCGACATTGCCGTGGAATGGG<br>AGAGCAACGGCCAGCCCGAGAACAACTACAAGACCACCCCCCCTGTGCTGGACAGCGACGGCTCATTCTTCCTGTAC<br>TCCAAGCTGACCGTGGACAAGAGCCGGTGGCAGGAAGGCAACGTGTTCAGCTGCTCCGTGATGCACGAGGCCCTGC |

TABLE 5-continued

| Trispecific binding protein polynucleotide sequences | | | |
|---|---|---|---|
| Molecule | Polypeptide Number (acc. to formula) | SEQ ID NO | Sequence |
| | | | ACAACCACTACACCCAGAAGTCCCTGTCTCTGTCCCTGGGC |
| | 4 | 537 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 19 N6/CD28sup x CD3mid_QQ IgG1_NNAS_ DKTHT linker | 1 | 538 | GACATCGTGATGACCCAGACCCCCCTGAGCCTGAGCGTGACACCTGGACAGCCTGCCAGCATCAGCTGCAAGAGCA<br>GCCAGAGCCTGGTGCACCAGAACGCCCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 539 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCCAGCGTGTTCCCTCTGGCCCCTAGCAGCAAGAGCACATCTGGCGGAACAGCCGCCCTGGGCTGCCTCGTGAAG<br>GACTACTTTCCCGAGCCCGTGACCGTGTCCTGGAATTCTGGCGCCCTGACCAGCGGCGTGCACACCTTTCCAGCTGTG<br>CTGCAGTCCAGCGGCCTGTACAGCCTGAGCAGCGTCGTGACAGTGCCCAGCAGCTCTCTGGGCACCCAGACCTACAT<br>CTGCAACGTGAACCACAAGCCCAGCAACACCAAGGTGGACAAGAAGGTGGAACCCAAGAGCTGCGACAAGACCCA<br>CACCTGTCCCCCTTGTCCTGCCCCCGAACTGCTGGGAGGCCCTTCCGTGTTCCTGTTCCCCCCAAAGCCCAAGGACAC<br>CCTGATGATCAGCCGGACCCCCGAAGTGACCTGCGTGGTGGTGGATGTGTCCCACGAGGACCCTGAAGTGAAGTTCA<br>ATTGGTACGTGGACGGCGTGGAAGTGCACAACGCCAAGACCAAGCCAAGAGAGGAACAGTACAACAATGCCTCCCG<br>GGTGGTGTCCGTGCTGACCGTGCTGCACCAGGACTGGCTGAACGGCAAAGAGTACAAGTGCAAGGTGTCCAACAAG<br>GCCCTGCCTGCCCCCATCGAGAAAACCATCAGCAAGGCCAAGGGCCAGCCCCGCGAACCCCAGGTGTGCACACTGC |

TABLE 5-continued

Trispecific binding protein polynucleotide sequences

| Molecule | Polypeptide Number (acc. to formula) | SEQ ID NO | Sequence |
|---|---|---|---|
| | | | CCCCAAGCAGGGACGAGCTGACCAAGAACCAGGTGTCCCTGAGCTGTGCCGTGAAAGGCTTCTACCCCTCCGATATC<br>GCCGTGGAATGGGAGAGCAACGGCCAGCCCGAGAACAACTACAAGACCACCCCCCCTGTGCTGGACAGCGACGGCT<br>CATTCTTCCTGGTGTCCAAGCTGACAGTGGACAAGTCCCGGTGGCAGCAGGGCAACGTGTTCAGCTGCTCCGTGATG<br>CACGAGGCCCTGCACAACCACTACACCCAGAAGTCCCTGAGCCTGAGCCCCGGC |
| | 3 | 540 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTCTTCCCCCTGGCACCCTCCTCCAAGAGCACCTCTGGGGGCACAGCGGCCCTGGGCTGCCTGGTCAAGGAC<br>TACTTCCCCGAACCGGTGACGGTGTCGTGGAACTCAGGCGCCCTGACCAGCGGCGTGCACACCTTCCCGGCTGTCCT<br>ACAGTCCTCAGGACTCTACTCCCTCAGCAGCGTGGTGACCGTGCCCTCCAGCAGCTTGGGCACCCAGACCTACATCT<br>GCAACGTGAATCACAAGCCCAGCAACACCAAGGTGGACAAGAAAGTTGAGCCCAAATCTTGTGACAAAACTCACAC<br>ATGCCCACCGTGCCCAGCACCTGAACTCCTGGGGGGACCGTCAGTCTTCCTCTTCCCCCCAAAACCCAAGGACACCC<br>TCATGATCTCCCGGACCCCTGAGGTCACATGCGTGGTGGTGGACGTGAGCCACGAAGACCCTGAGGTCAAGTTCAAC<br>TGGTATGTTGACGGCGTGGAGGTGCATAATGCCAAGACAAAGCCGCGGGAGGAGCAGTACAACAATGCCTCCCGTG<br>TGGTCAGCGTCCTCACCGTCCTGCACCAGGACTGGCTGAATGGCAAGGAGTACAAGTGCAAGGTCTCCAACAAAGCC<br>CTCCCAGCCCCCATCGAGAAAACCATCTCCAAAGCCAAAGGGCAGCCCCGAGAACCACAGGTGTACACCCTGCCCC<br>CATGCCGGGATGAGCTGACCAAGAATCAAGTCAGCCTGTGGTGCCTGGTAAAAGGCTTCTATCCCAGCGACATCGCC<br>GTGGAGTGGGAGAGCAATGGGCAGCCGGAGAACAACTACAAGACCACGCCTCCCGTGCTGGACTCCGACGGCTCCT<br>TCTTCCTCTACTCAAAACTCACCGTGGACAAGAGCAGGTGGCAGCAGGGGAACGTCTTCTCATGCTCCGTGATGCAT<br>GAGGCTCTGCACAACCACTACACGCAGAAGAGCCTCTCCCTGTCTCCGGGT |
| | 4 | 541 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 21 N6/CD28sup x CD3mid_ DNAQ IgG4 FALA/409K_ DKTHT linker | 1 | 542 | GACATCGTGATGACCCAGACCCCCCTGAGCCTGAGCGTGACACCTGGACAGCCTGCCAGCATCAGCTGCAAGAGCA<br>GCCAGAGCCTGGTGCACGACAACGCCCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCAG<br>TCAGCCCAAGGCTGCCCCCTCGGTCACTCTGTTCCCGCCCTCGAGTGAGGAGCTTCAAGCCAACAAGGCCACACTGG<br>TGTGTCTCATAAGTGACTTCTACCCGGGAGCCGTGACAGTGGCCTGGAAGGCAGATAGCAGCCCCGTCAAGGCGGG<br>AGTGGAGACCACCACACCCTCCAAACAAAGCAACAACAAGTACGCGGCCAGCAGCTACCTGAGCCTGACGCCTGAG |

TABLE 5-continued

| Trispecific binding protein polynucleotide sequences | | | |
|---|---|---|---|
| Molecule | Polypeptide Number (acc. to formula) | SEQ ID NO | Sequence |
| | | | CAGTGGAAGTCCCACAGAAGCTACAGCTGCCAGGTCACGCATGAAGGGAGCACCGTGGAGAAGACAGTGGCCCCTA CAGAATGT |
| | 2 | 543 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAAC ACCCTGTACCTGCAGATGAACAGCCTGCGGGCCGAGGACACCGCCGTGTACTACTGTCGGGGCGTGTACTATGCCCT GAGCCCCTTCGATTACTGGGGCCAGGGAACCCTCGTGACCGTGTCTAGTGATAAGACCCACACCGCCAGCACAAAGG GCCCATCGGTGTTCCCTCTGGCCCCTTGCAGCAGAAGCACCAGCGAATCTACAGCCGCCCTGGGCTGCCTCGTGAAG GACTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTACAC CTGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGATC AGCCGGACCCCCGAAGTGACCTGCGTGGTGGTGGATGTGTCCCAGGAAGATCCCGAGGTGCAGTTCAATTGGTACGT GGACGGCGTGGAAGTGCACAACGCCAAGACCAAGCCCAGAGAGGAACAGTTCAACAGCACCTACCGGGTGGTGTCC GTGCTGACCGTGCTGCACCAGGACTGGCTGAACGGCAAAGAGTACAAGTGCAAGGTGTCCAACAAGGGCCTGCCCA GCTCCATCGAGAAAACCATCAGCAAGGCCAAGGGCCAGCCCCGCGAGCCTCAAGTGTGTACCCTGCCCCCTAGCCA GGAAGAGATGACCAAGAACCAGGTGTCCCTGAGCTGTGCCGTGAAAGGCTTCTACCCCAGCGACATTGCCGTGGAA TGGGAGAGCAACGGCCAGCCCGAGAACAACTACAAGACCACCCCCCCTGTGCTGGACAGCGACGGCTCATTCTTCCT GGTGTCCAAGCTGACCGTGGACAAGAGCCGGTGGCAGGAAGGCAACGTGTTCAGCTGCTCCGTGATGCACGAGGCC CTGCACAACCACTACACCCAGAAGTCCCTGTCTCTGTCCCTGGGC |
| | 3 | 544 | AGAGCCCACCTGGTGCAGTCTGGCACCGCCATGAAGAAACCAGGCGCCTCTGTGCGGGTGTCCTGTCAGACAAGCG GCTACACCTTCACCGCCCACATCCTGTTCTGGTTCCGGCAGGCCCCTGGCAGAGGACTGGAATGGGTGGGATGGATC AAGCCCCAGTATGGCGCCGTGAACTTCGGCGGAGGCTTCCGGGATAGAGTGACCCTGACCCGGGACGTGTACCGCG AGATCGCCTACATGGACATCCGGGGCCTGAAGCCCGATGACACCGCCGTGTACTACTGCGCCAGAGACAGAAGCTA CGGCGACAGCAGCTGGGCTCTGGATGCTTGGGGCCAGGGCACAACCGTGGTGGTGTCTGCCGCCTCTACAAAGGGCC CATCGGTGTTCCCTCTGGCCCCTTGCAGCAGAAGCACCAGCGAATCTACAGCCGCCNTGGGCTGCCTCGTGAAGGAC TACTTTCCCGAGCCCGTGACCGTGTCCTGGAACTCTGGCGCTCTGACAAGCGGCGTGCACACCTTTCCAGCCGTGCTC CAGAGCAGCGGCCTGTACTCTCTGAGCAGCGTCGTGACAGTGCCCAGCAGCAGCCTGGGCACCAAGACCTACACCTG TAACGTGGACCACAAGCCCAGCAACACCAAGGTGGACAAGCGGGTGGAATCTAAGTACGGCCCTCCCTGCCCTCCTT GCCCAGCCCCTGAAGCTGCCGGCGGACCCTCCGTGTTCCTGTTCCCCCCAAAGCCCAAGGACACCCTGATGATCAGC CGGACCCCCGAAGTGACCTGCGTGGTGGTGGATGTGTCCCAGGAAGATCCCGAGGTGCAGTTCAATTGGTACGTGGA CGGCGTGGAAGTGCACAACGCCAAGACCAAGCCCAGAGAGGAACAGTTCAACAGCACCTACCGGGTGGTGTCCGTG CTGACCGTGCTGCACCAGGACTGGCTGAACGGCAAAGAGTACAAGTGCAAGGTGTCCAACAAGGGCCTGCCCAGCT CCATCGAGAAAACCATCAGCAAGGCCAAGGGCCAGCCCCGCGAGCCTCAAGTGTATACCCTGCCCCCTTGCCAGGA AGAGATGACCAAGAACCAGGTGTCCCTGTGGTGTCTCGTGAAAGGCTTCTACCCCAGCGACATTGCCGTGGAATGGG AGAGCAACGGCCAGCCCGAGAACAACTACAAGACCACCCCCCCTGTGCTGGACAGCGACGGCTCATTCTTCCTGTAC TCCAAGCTGACCGTGGACAAGAGCCGGTGGCAGGAAGGCAACGTGTTCAGCTGCTCCGTGATGCACGAGGCCCTGC ACAACCACTACACCCAGAAGTCCCTGTCTCTGTCCCTGGGC |

TABLE 5-continued

| Trispecific binding protein polynucleotide sequences | | | |
|---|---|---|---|
| Molecule | Polypeptide Number (acc. to formula) | SEQ ID NO | Sequence |
| | 4 | 545 | TACATCCACGTGACCCAGAGCCCCAGCAGCCTGTCCGTGTCCATCGGCGACAGAGTGACCATCAACTGCCAGACCTC TCAGGGCGTGGGCAGCGACCTGCACTGGTATCAGCACAAGCCTGGCAGAGCCCCCAAGCTGCTGATCCACCACACA AGCAGCGTGGAAGATGGCGTGCCCAGCAGATTTTCCGGCAGCGGCTTCCACACCAGCTTCAACCTGACCATCAGCGA TCTGCAGGCCGACGACATTGCCACCTACTATTGTCAGGTGCTGCAGTTCTTCGGCAGAGGCAGCAGACTGCACATCA AGCGTACGGTGGCCGCTCCCAGCGTGTTCATCTTCCCACCTAGCGACGAGCAGCTGAAGTCCGGCACAGCCTCTGTC GTGTGCCTGCTGAACAACTTCTACCCCCGCGAGGCCAAAGTGCAGTGGAAGGTGGACAACGCCCTGCAGAGCGGCA ACAGCCAGGAAAGCGTGACCGAGCAGGACAGCAAGGACTCCACCTACAGCCTGAGCAGCACCCTGACACTGAGCAA GGCCGACTACGAGAAGCACAAGGTGTACGCCTGCGAAGTGACCCACCAGGGCCTGTCTAGCCCCGTGACCAAGAGC TTCAACCGGGGCGAGTGT |
| Trispecific 22 N6/CD28sup x CD3mid_ ENLQ IgG4 FALA/409K_ DKTHT linker | 1 | 546 | GACATCGTGATGACCCAGACCCCCCTGAGCCTGAGCGTGACACCTGGACAGCCTGCCAGCATCAGCTGCAAGAGCA GCCAGAGCCTGGTGCACGAGAACCTGCAGACCTACCTGAGCTGGTATCTGCAGAAGCCCGGCCAGAGCCCCCAGTC CCTGATCTACAAGGTGTCCAACAGATTCAGCGGCGTGCCCGACAGATTCTCCGGCAGCGGCTCTGGCACCGACTTCA CCCTGAAGATCAGCCGGGTGGAAGCCGAGGACGTGGGCGTGTACTATTGTGGCCAGGGCACCCAGTACCCCTTCACC TTTGGCAGCGGCACCAAGGTGGAAATCAAGGACAAAACCCATACCGACATCCAGATGACCCAGAGCCCCAGCAGCC TGTCTGCCAGCGTGGGCGACAGAGTGACCATCACCTGTCAGGCCAGCCAGAACATCTACGTGTGGCTGAACTGGTAT CAGCAGAAGCCCGGCAAGGCCCCCAAGCTGCTGATCTACAAGGCCAGCAACCTGCACACCGGCGTGCCCAGCAGAT TTTCTGGCAGCGGCTCCGGCACCGACTTCACCCTGACAATCAGCTCCCTGCAGCCCGAGGACATTGCCACCTACTACT GCCAGCAGGGCCAGACCTACCCCTACACCTTTGGCCAGGGCACCAAGCTGGAAATCAAGGATAAGACCCACACCCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| | 2 | 547 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAAC ACCCTGTACCTGCAGATGAACAGCCTGCGGGCCGAGGACACCGCCGTGTACTACTGTCGGGGCGTGTACTATGCCCT GAGCCCCTTCGATTACTGGGGCCAGGGAACCCTCGTGACCGTGTCTAGTGATAAGACCCACACCGCCAGCACAAAGG GCCCATCGGTGTTCCCTCTGGCCCCTTGCAGCAGAAGCACCAGCGAATCTACAGCCGCCCTGGGCTGCCTCGTGAAG GACTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTACAC CTGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGATC AGCCGGACCCCCGAAGTGACCTGCGTGGTGGTGGATGTGTCCCAGGAAGATCCCGAGGTGCAGTTCAATTGGTACGT GGACGGCGTGGAAGTGCACAACGCCAAGACCAAGCCCAGAGAGGAACAGTTCAACAGCACCTACCGGGTGGTGTCC GTGCTGACCGTGCTGCACCAGGACTGGCTGAACGGCAAAGAGTACAAGTGCAAGGTGTCCAACAAGGGCCTGCCCA GCTCCATCGAGAAAACCATCAGCAAGGCCAAGGGCCAGCCCCGCGAGCCTCAAGTGTGTACCCTGCCCCCTAGCCA GGAAGAGATGACCAAGAACCAGGTGTCCCTGAGCTGTGCCGTGAAAGGCTTCTACCCCAGCGACATTGCCGTGGAA TGGGAGAGCAACGGCCAGCCCGAGAACAACTACAAGACCACCCCCCCTGTGCTGGACAGCGACGGCTCATTCTTCCT |

TABLE 5-continued

| Trispecific binding protein polynucleotide sequences | | | |
|---|---|---|---|
| Molecule | Polypeptide Number (acc. to formula) | SEQ ID NO | Sequence |
| | | | GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 548 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTGTTCCCTCTGGCCCCTTGCAGCAGAAGCACCAGCGAATCTACAGCCGCCNTGGGCTGCCTCGTGAAGGAC<br>TACTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACCTG<br>TAACGTGGACCACAAGCCCAGCAACACCAAGGTGGACAAGCGGGTGGAATCTAAGTACGGCCCTCCCTGCCCTCCTT<br>GCCCAGCCCCTGAAGCTGCCGGCGGACCCTCCGTGTTCCTGTTCCCCCCAAAGCCCAAGGACACCCTGATGATCAGC<br>CGGACCCCCGAAGTGACCTGCGTGGTGGTGGATGTGTCCCAGGAAGATCCCGAGGTGCAGTTCAATTGGTACGTGGA<br>CGGCGTGGAAGTGCACAACGCCAAGACCAAGCCCAGAGAGGAACAGTTCAACAGCACCTACCGGGTGGTGTCCGTG<br>CTGACCGTGCTGCACCAGGACTGGCTGAACGGCAAAGAGTACAAGTGCAAGGTGTCCAACAAGGGCCTGCCCAGCT<br>CCATCGAGAAAACCATCAGCAAGGCCAAGGGCCAGCCCCGCGAGCCTCAAGTGTATACCCTGCCCCCTTGCCAGGA<br>AGAGATGACCAAGAACCAGGTGTCCCTGTGGTGTCTCGTGAAAGGCTTCTACCCCAGCGACATTGCCGTGGAATGGG<br>AGAGCAACGGCCAGCCCGAGAACAACTACAAGACCACCCCCCCTGTGCTGGACAGCGACGGCTCATTCTTCCTGTAC<br>TCCAAGCTGACCGTGGACAAGAGCCGGTGGCAGGAAGGCAACGTGTTCAGCTGCTCCGTGATGCACGAGGCCCTGC<br>ACAACCACTACACCCAGAAGTCCCTGTCTCTGTCCCTGGGC |
| | 4 | 549 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 23<br>N6/CD28sup<br>x<br>CD3mid_<br>ENLR IgG4<br>FALA/409K_<br>DKTHT linker | 1 | 550 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGCGTACCTACCTGAGCTGGTATCTGCAGAAGCCCGGCCAGAGCCCCCAGTCC<br>CTGATCTACAAGGTGTCCAACAGATTCAGCGGCGTGCCCGACAGATTCTCCGGCAGCGGCTCTGGCACCGACTTCAC<br>CCTGAAGATCAGCCGGGTGGAAGCCGAGGACGTGGGCGTGTACTATTGTGGCCAGGGCACCCAGTACCCCTTCACCT<br>TTGGCAGCGGCACCAAGGTGGAAATCAAGGACAAAACCCATACCGACATCCAGATGACCCAGAGCCCCAGCAGCCT<br>GTCTGCCAGCGTGGGCGACAGAGTGACCATCACCTGTCAGGCCAGCCAGAACATCTACGTGTGGCTGAACTGGTATC<br>AGCAGAAGCCCGGCAAGGCCCCCAAGCTGCTGATCTACAAGGCCAGCAACCTGCACACCGGCGTGCCCAGCAGATT<br>TTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |

TABLE 5-continued

| Trispecific binding protein polynucleotide sequences | | | |
|---|---|---|---|
| Molecule | Polypeptide Number (acc. to formula) | SEQ ID NO | Sequence |
| | 2 | 551 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC<br>CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC<br>GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 552 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTGTTCCCTCTGGCCCCTTGCAGCAGAAGCACCAGCGAATCTACAGCCGCCNTGGGCTGCCTCGTGAAGGAC<br>TACTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACCTG<br>TAACGTGGACCACAAGCCCAGCAACACCAAGGTGGACAAGCGGGTGGAATCTAAGTACGGCCCTCCCTGCCCTCCTT<br>GCCCAGCCCCTGAAGCTGCCGGCGGACCCTCCGTGTTCCTGTTCCCCCCAAAGCCCAAGGACACCCTGATGATCAGC<br>CGGACCCCCGAAGTGACCTGCGTGGTGGTGGATGTGTCCCAGGAAGATCCCGAGGTGCAGTTCAATTGGTACGTGGA<br>CGGCGTGGAAGTGCACAACGCCAAGACCAAGCCCAGAGAGGAACAGTTCAACAGCACCTACCGGGTGGTGTCCGTG<br>CTGACCGTGCTGCACCAGGACTGGCTGAACGGCAAAGAGTACAAGTGCAAGGTGTCCAACAAGGGCCTGCCCAGCT<br>CCATCGAGAAAACCATCAGCAAGGCCAAGGGCCAGCCCCGCGAGCCTCAAGTGTATACCCTGCCCCCTTGCCAGGA<br>AGAGATGACCAAGAACCAGGTGTCCCTGTGGTGTCTCGTGAAAGGCTTCTACCCCAGCGACATTGCCGTGGAATGGG<br>AGAGCAACGGCCAGCCCGAGAACAACTACAAGACCACCCCCCCTGTGCTGGACAGCGACGGCTCATTCTTCCTGTAC<br>TCCAAGCTGACCGTGGACAAGAGCCGGTGGCAGGAAGGCAACGTGTTCAGCTGCTCCGTGATGCACGAGGCCCTGC<br>ACAACCACTACACCCAGAAGTCCCTGTCTCTGTCCCTGGGC |
| | 4 | 553 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA |

TABLE 5-continued

| Trispecific binding protein polynucleotide sequences | | | |
|---|---|---|---|
| Molecule | Polypeptide Number (acc. to formula) | SEQ ID NO | Sequence |
| | | | AGCAGCGTGGAAGATGGCGTGCCCAGCAGATTTTCCGGCAGCGGCTTCCACACCAGCTTCAACCTGACCATCAGCGA TCTGCAGGCCGACGACATTGCCACCTACTATTGTCAGGTGCTGCAGTTCTTCGGCAGAGGCAGCAGACTGCACATCA AGCGTACGGTGGCCGCTCCCAGCGTGTTCATCTTCCCACCTAGCGACGAGCAGCTGAAGTCCGGCACAGCCTCTGTC GTGTGCCTGCTGAACAACTTCTACCCCCGCGAGGCCAAAGTGCAGTGGAAGGTGGACAACGCCCTGCAGAGCGGCA ACAGCCAGGAAAGCGTGACCGAGCAGGACAGCAAGGACTCCACCTACAGCCTGAGCAGCACCCTGACACTGAGCAA GGCCGACTACGAGAAGCACAAGGTGTACGCCTGCGAAGTGACCCACCAGGGCCTGTCTAGCCCCGTGACCAAGAGC TTCAACCGGGGCGAGTGT |
| Trispecific 24 N6/CD28sup x CD3mid_ ENLF IgG4 FALA/409K_ DKTHT linker | 1 | 554 | GACATCGTGATGACCCAGACCCCCCTGAGCCTGAGCGTGACACCTGGACAGCCTGCCAGCATCAGCTGCAAGAGCA GCCAGAGCCTGGTGCACGAGAACCTGTTCACCTACCTGAGCTGGTATCTGCAGAAGCCCGGCCAGAGCCCCCAGTCC CTGATCTACAAGGTGTCCAACAGATTCAGCGGCGTGCCCGACAGATTCTCCGGCAGCGGCTCTGGCACCGACTTCAC CCTGAAGATCAGCCGGGTGGAAGCCGAGGACGTGGGCGTGTACTATTGTGGCCAGGGCACCCAGTACCCCTTCACCT TTGGCAGCGGCACCAAGGTGGAAATCAAGGACAAAACCCATACCGACATCCAGATGACCCAGAGCCCCAGCAGCCT GTCTGCCAGCGTGGGCGACAGAGTGACCATCACCTGTCAGGCCAGCCAGAACATCTACGTGTGGCTGAACTGGTATC AGCAGAAGCCCGGCAAGGCCCCCAAGCTGCTGATCTACAAGGCCAGCAACCTGCACACCGGCGTGCCCAGCAGATT TTCTGGCAGCGGCTCCGGCACCGACTTCACCCTGACAATCAGCTCCCTGCAGCCCGAGGACATTGCCACCTACTACT GCCAGCAGGGCCAGACCTACCCCTACACCTTTGGCCAGGGCACCAAGCTGGAAATCAAGGATAAGACCCACACCCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| | 2 | 555 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAAC ACCCTGTACCTGCAGATGAACAGCCTGCGGGCCGAGGACACCGCCGTGTACTACTGTCGGGGCGTGTACTATGCCCT GAGCCCCTTCGATTACTGGGGCCAGGGAACCCTCGTGACCGTGTCTAGTGATAAGACCCACACCGCCAGCACAAAGG GCCCATCGGTGTTCCCTCTGGCCCCTTGCAGCAGAAGCACCAGCGAATCTACAGCCGCCCTGGGCTGCCTCGTGAAG GACTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTACAC CTGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGATC AGCCGGACCCCCGAAGTGACCTGCGTGGTGGTGGATGTGTCCCAGGAAGATCCCGAGGTGCAGTTCAATTGGTACGT GGACGGCGTGGAAGTGCACAACGCCAAGACCAAGCCCAGAGAGGAACAGTTCAACAGCACCTACCGGGTGGTGTCC GTGCTGACCGTGCTGCACCAGGACTGGCTGAACGGCAAAGAGTACAAGTGCAAGGTGTCCAACAAGGGCCTGCCCA GCTCCATCGAGAAAACCATCAGCAAGGCCAAGGGCCAGCCCCGCGAGCCTCAAGTGTGTACCCTGCCCCCTAGCCA GGAAGAGATGACCAAGAACCAGGTGTCCCTGAGCTGTGCCGTGAAAGGCTTCTACCCCAGCGACATTGCCGTGGAA TGGGAGAGCAACGGCCAGCCCGAGAACAACTACAAGACCACCCCCCCTGTGCTGGACAGCGACGGCTCATTCTTCCT GGTGTCCAAGCTGACCGTGGACAAGAGCCGGTGGCAGGAAGGCAACGTGTTCAGCTGCTCCGTGATGCACGAGGCC CTGCACAACCACTACACCCAGAAGTCCCTGTCTCTGTCCCTGGGC |

TABLE 5-continued

Trispecific binding protein polynucleotide sequences

| Molecule | Polypeptide Number (acc. to formula) | SEQ ID NO | Sequence |
|---|---|---|---|
| | 3 | 556 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTGTTCCCTCTGGCCCCTTGCAGCAGAAGCACCAGCGAATCTACAGCCGCCNTGGGCTGCCTCGTGAAGGAC<br>TACTTTCCCGAGCCCGTGACCGTGTCCTGGAACTCTGGCGCTCTGACAAGCGGCGTGCACACCTTTCCAGCCGTGCTC<br>CAGAGCAGCGGCCTGTACTCTCTGAGCAGCGTCGTGACAGTGCCCAGCAGCAGCCTGGGCACCAAGACCTACACCTG<br>TAACGTGGACCACAAGCCCAGCAACACCAAGGTGGACAAGCGGGTGGAATCTAAGTACGGCCCTCCCTGCCCTCCTT<br>GCCCAGCCCCTGAAGCTGCCGGCGGACCCTCCGTGTTCCTGTTCCCCCCAAAGCCCAAGGACACCCTGATGATCAGC<br>CGGACCCCCGAAGTGACCTGCGTGGTGGTGGATGTGTCCCAGGAAGATCCCGAGGTGCAGTTCAATTGGTACGTGGA<br>CGGCGTGGAAGTGCACAACGCCAAGACCAAGCCCAGAGAGGAACAGTTCAACAGCACCTACCGGGTGGTGTCCGTG<br>CTGACCGTGCTGCACCAGGACTGGCTGAACGGCAAAGAGTACAAGTGCAAGGTGTCCAACAAGGGCCTGCCCAGCT<br>CCATCGAGAAAACCATCAGCAAGGCCAAGGGCCAGCCCCGCGAGCCTCAAGTGTATACCCTGCCCCCTTGCCAGGA<br>AGAGATGACCAAGAACCAGGTGTCCCTGTGGTGTCTCGTGAAAGGCTTCTACCCCAGCGACATTGCCGTGGAATGGG<br>AGAGCAACGGCCAGCCCGAGAACAACTACAAGACCACCCCCCCTGTGCTGGACAGCGACGGCTCATTCTTCCTGTAC<br>TCCAAGCTGACCGTGGACAAGAGCCGGTGGCAGGAAGGCAACGTGTTCAGCTGCTCCGTGATGCACGAGGCCCTGC<br>ACAACCACTACACCCAGAAGTCCCTGTCTCTGTCCCTGGGC |
| | 4 | 557 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 25 N6_rw52/ CD28sup x CD3mid_ ENLQ IgG4 FALA/409K_ DKTHT linker | 1 | 558 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 559 | CAGGTGCAGCTGGTGCAGTCTGGCGCCGAGGTCGTGAAACCTGGCGCCTCTGTGAAGGTGTCCTGCAAGGCCAGCGG |

TABLE 5-continued

Trispecific binding protein polynucleotide sequences

| Molecule | Polypeptide Number (acc. to formula) | SEQ ID NO | Sequence |
|---|---|---|---|
| | | | CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAAC ACCCTGTACCTGCAGATGAACAGCCTGCGGGCCGAGGACACCGCCGTGTACTACTGTCGGGGCGTGTACTATGCCCT GAGCCCCTTCGATTACTGGGGCCAGGGAACCCTCGTGACCGTGTCTAGTGATAAGACCCACACCGCCAGCACAAAGG GCCCATCGGTGTTCCCTCTGGCCCCTTGCAGCAGAAGCACCAGCGAATCTACAGCCGCCCTGGGCTGCCTCGTGAAG GACTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTACAC CTGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGATC AGCCGGACCCCCGAAGTGACCTGCGTGGTGGTGGATGTGTCCCAGGAAGATCCCGAGGTGCAGTTCAATTGGTACGT GGACGGCGTGGAAGTGCACAACGCCAAGACCAAGCCCAGAGAGGAACAGTTCAACAGCACCTACCGGGTGGTGTCC GTGCTGACCGTGCTGCACCAGGACTGGCTGAACGGCAAAGAGTACAAGTGCAAGGTGTCCAACAAGGGCCTGCCCA GCTCCATCGAGAAAACCATCAGCAAGGCCAAGGGCCAGCCCCGCGAGCCTCAAGTGTGTACCCTGCCCCCTAGCCA GGAAGAGATGACCAAGAACCAGGTGTCCCTGAGCTGTGCCGTGAAAGGCTTCTACCCCAGCGACATTGCCGTGGAA TGGGAGAGCAACGGCCAGCCCGAGAACAACTACAAGACCACCCCCCCTGTGCTGGACAGCGACGGCTCATTCTTCCT GGTGTCCAAGCTGACCGTGGACAAGAGCCGGTGGCAGGAAGGCAACGTGTTCAGCTGCTCCGTGATGCACGAGGCC CTGCACAACCACTACACCCAGAAGTCCCTGTCTCTGTCCCTGGGC |
| | 3 | 560 | AGAGCCCACCTGGTGCAGTCTGGCACCGCCATGAAGAAACCAGGCGCCTCTGTGCGGGTGTCCTGTCAGACAAGCG GCTACACCTTCACCGCCCACATCCTGTTCTGGTTCCGGCAGGCCCCTGGCAGAGGACTGGAATGGGTGGGATGGATC AAGCCCCAGTATGGCGCCACCAACTTCGGCGGAGGCTTCCGGGATAGAGTGACCCTGACCCGGGACGTGTACCGCG AGATCGCCTACATGGACATCCGGGGCCTGAAGCCCGATGACACCGCCGTGTACTACTGCGCCAGAGACAGAAGCTA CGGCGACAGCAGCTGGGCTCTGGATGCTTGGGGCCAGGGCACAACCGTGGTGGTGTCTGCCGCCTCTACAAAGGGCC CATCGGTGTTCCCTCTGGCCCCTTGCAGCAGAAGCACCAGCGAATCTACAGCCGCCCTGGGCTGCCTCGTGAAGGAC TACTTTCCCGAGCCCGTGACCGTGTCCTGGAACTCTGGCGCTCTGACAAGCGGCGTGCACACCTTTCCAGCCGTGCTC CAGAGCAGCGGCCTGTACTCTCTGAGCAGCGTCGTGACAGTGCCCAGCAGCAGCCTGGGCACCAAGACCTACACCTG TAACGTGGACCACAAGCCCAGCAACACCAAGGTGGACAAGCGGGTGGAATCTAAGTACGGCCCTCCCTGCCCTCCTT GCCCAGCCCCTGAAGCTGCCGGCGGACCCTCCGTGTTCCTGTTCCCCCCAAAGCCCAAGGACACCCTGATGATCAGC CGGACCCCCGAAGTGACCTGCGTGGTGGTGGATGTGTCCCAGGAAGATCCCGAGGTGCAGTTCAATTGGTACGTGGA CGGCGTGGAAGTGCACAACGCCAAGACCAAGCCCAGAGAGGAACAGTTCAACAGCACCTACCGGGTGGTGTCCGTG CTGACCGTGCTGCACCAGGACTGGCTGAACGGCAAAGAGTACAAGTGCAAGGTGTCCAACAAGGGCCTGCCCAGCT CCATCGAGAAAACCATCAGCAAGGCCAAGGGCCAGCCCCGCGAGCCTCAAGTGTATACCCTGCCCCCTTGCCAGGA AGAGATGACCAAGAACCAGGTGTCCCTGTGGTGTCTCGTGAAAGGCTTCTACCCCAGCGACATTGCCGTGGAATGGG AGAGCAACGGCCAGCCCGAGAACAACTACAAGACCACCCCCCCTGTGCTGGACAGCGACGGCTCATTCTTCCTGTAC TCCAAGCTGACCGTGGACAAGAGCCGGTGGCAGGAAGGCAACGTGTTCAGCTGCTCCGTGATGCACGAGGCCCTGC ACAACCACTACACCCAGAAGTCCCTGTCTCTGTCCCTGGGC |
| | 4 | 561 | TACATCCACGTGACCCAGAGCCCCAGCAGCCTGTCCGTGTCCATCGGCGACAGAGTGACCATCAACTGCCAGACCTC TCAGGGCGTGGGCAGCGACCTGCACTGGTATCAGCACAAGCCTGGCAGAGCCCCCAAGCTGCTGATCCACCACACA AGCAGCTCCGAAGAGGGCGTGCCCAGCAGATTTTCCGGCAGCGGCTTCCACACCAGCTTCAACCTGACCATCAGCGA TCTGCAGGCCGACGACATTGCCACCTACTATTGTCAGGTGCTGCAGTTCTTCGGCAGAGGCAGCAGACTGCACATCA |

TABLE 5-continued

Trispecific binding protein polynucleotide sequences

| Molecule | Polypeptide Number (acc. to formula) | SEQ ID NO | Sequence |
| --- | --- | --- | --- |
| | | | AGCGTACGGTGGCCGCTCCCAGCGTGTTCATCTTCCCACCTAGCGACGAGCAGCTGAAGTCCGGCACAGCCTCTGTC GTGTGCCTGCTGAACAACTTCTACCCCCGCGAGGCCAAAGTGCAGTGGAAGGTGGACAACGCCCTGCAGAGCGGCA ACAGCCAGGAAAGCGTGACCGAGCAGGACAGCAAGGACTCCACCTACAGCCTGAGCAGCACCCTGACACTGAGCAA GGCCGACTACGAGAAGCACAAGGTGTACGCCTGCGAAGTGACCCACCAGGGCCTGTCTAGCCCCGTGACCAAGAGC TTCAACCGGGGCGAGTGT |
| Trispecific 26 N6_rw52/ CD28sup x CD3mid_ ENLF IgG4 FALA/409K_ DKTHT linker | 1 | 562 | GACATCGTGATGACCCAGACCCCCCTGAGCCTGAGCGTGACACCTGGACAGCCTGCCAGCATCAGCTGCAAGAGCA GCCAGAGCCTGGTGCACGAGAACCTGTTCACCTACCTGAGCTGGTATCTGCAGAAGCCCGGCCAGAGCCCCCAGTCC CTGATCTACAAGGTGTCCAACAGATTCAGCGGCGTGCCCGACAGATTCTCCGGCAGCGGCTCTGGCACCGACTTCAC CCTGAAGATCAGCCGGGTGGAAGCCGAGGACGTGGGCGTGTACTATTGTGGCCAGGGCACCCAGTACCCCTTCACCT TTGGCAGCGGCACCAAGGTGGAAATCAAGGACAAAACCCATACCGACATCCAGATGACCCAGAGCCCCAGCAGCCT GTCTGCCAGCGTGGGCGACAGAGTGACCATCACCTGTCAGGCCAGCCAGAACATCTACGTGTGGCTGAACTGGTATC AGCAGAAGCCCGGCAAGGCCCCCAAGCTGCTGATCTACAAGGCCAGCAACCTGCACACCGGCGTGCCCAGCAGATT TTCTGGCAGCGGCTCCGGCACCGACTTCACCCTGACAATCAGCTCCCTGCAGCCCGAGGACATTGCCACCTACTACT GCCAGCAGGGCCAGACCTACCCCTACACCTTTGGCCAGGGCACCAAGCTGGAAATCAAGGATAAGACCCACACCCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| | 2 | 563 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA GAGCAACAGCTACGCCACCTACTACGCCGACAGCGTGAAGGGCCGGTTCACCATCAGCCGGGACGACAGCAAGAAC ACCCTGTACCTGCAGATGAACAGCCTGCGGGCCGAGGACACCGCCGTGTACTACTGTCGGGGCGTGTACTATGCCCT GAGCCCCTTCGATTACTGGGGCCAGGGAACCCTCGTGACCGTGTCTAGTGATAAGACCCACACCGCCAGCACAAAGG GCCCATCGGTGTTCCCTCTGGCCCCTTGCAGCAGAAGCACCAGCGAATCTACAGCCGCCCTGGGCTGCCTCGTGAAG GACTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTACAC CTGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGATC AGCCGGACCCCCGAAGTGACCTGCGTGGTGGTGGATGTGTCCCAGGAAGATCCCGAGGTGCAGTTCAATTGGTACGT GGACGGCGTGGAAGTGCACAACGCCAAGACCAAGCCCAGAGAGGAACAGTTCAACAGCACCTACCGGGTGGTGTCC GTGCTGACCGTGCTGCACCAGGACTGGCTGAACGGCAAAGAGTACAAGTGCAAGGTGTCCAACAAGGGCCTGCCCA GCTCCATCGAGAAAACCATCAGCAAGGCCAAGGGCCAGCCCCGCGAGCCTCAAGTGTGTACCCTGCCCCCTAGCCA GGAAGAGATGACCAAGAACCAGGTGTCCCTGAGCTGTGCCGTGAAAGGCTTCTACCCCAGCGACATTGCCGTGGAA TGGGAGAGCAACGGCCAGCCCGAGAACAACTACAAGACCACCCCCCCTGTGCTGGACAGCGACGGCTCATTCTTCCT GGTGTCCAAGCTGACCGTGGACAAGAGCCGGTGGCAGGAAGGCAACGTGTTCAGCTGCTCCGTGATGCACGAGGCC CTGCACAACCACTACACCCAGAAGTCCCTGTCTCTGTCCCTGGGC |
| | 3 | 564 | AGAGCCCACCTGGTGCAGTCTGGCACCGCCATGAAGAAACCAGGCGCCTCTGTGCGGGTGTCCTGTCAGACAAGCG |

TABLE 5-continued

| Trispecific binding protein polynucleotide sequences | | | |
|---|---|---|---|
| Molecule | Polypeptide Number (acc. to formula) | SEQ ID NO | Sequence |
| | | | GCTACACCTTCACCGCCCACATCCTGTTCTGGTTCCGGCAGGCCCCTGGCAGAGGACTGGAATGGGTGGGATGGATC AAGCCCCAGTATGGCGCCACCAACTTCGGCGGAGGCTTCCGGGATAGAGTGACCCTGACCCGGGACGTGTACCGCG AGATCGCCTACATGGACATCCGGGGCCTGAAGCCCGATGACACCGCCGTGTACTACTGCGCCAGAGACAGAAGCTA CGGCGACAGCAGCTGGGCTCTGGATGCTTGGGGCCAGGGCACAACCGTGGTGGTGTCTGCCGCCTCTACAAAGGGCC CATCGGTGTTCCCTCTGGCCCCTTGCAGCAGAAGCACCAGCGAATCTACAGCCGCCCTGGGCTGCCTCGTGAAGGAC TACTTTCCCGAGCCCGTGACCGTGTCCTGGAACTCTGGCGCTCTGACAAGCGGCGTGCACACCTTTCCAGCCGTGCTC CAGAGCAGCGGCCTGTACTCTCTGAGCAGCGTCGTGACAGTGCCCAGCAGCAGCCTGGGCACCAAGACCTACACCTG TAACGTGGACCACAAGCCCAGCAACACCAAGGTGGACAAGCGGGTGGAATCTAAGTACGGCCCTCCCTGCCCTCCTT GCCCAGCCCCTGAAGCTGCCGGCGGACCCTCCGTGTTCCTGTTCCCCCCAAAGCCCAAGGACACCCTGATGATCAGC CGGACCCCCGAAGTGACCTGCGTGGTGGTGGATGTGTCCCAGGAAGATCCCGAGGTGCAGTTCAATTGGTACGTGGA CGGCGTGGAAGTGCACAACGCCAAGACCAAGCCCAGAGAGGAACAGTTCAACAGCACCTACCGGGTGGTGTCCGTG CTGACCGTGCTGCACCAGGACTGGCTGAACGGCAAAGAGTACAAGTGCAAGGTGTCCAACAAGGGCCTGCCCAGCT CCATCGAGAAAACCATCAGCAAGGCCAAGGGCCAGCCCCGCGAGCCTCAAGTGTATACCCTGCCCCCTTGCCAGGA AGAGATGACCAAGAACCAGGTGTCCCTGTGGTGTCTCGTGAAAGGCTTCTACCCCAGCGACATTGCCGTGGAATGGG AGAGCAACGGCCAGCCCGAGAACAACTACAAGACCACCCCCCCTGTGCTGGACAGCGACGGCTCATTCTTCCTGTAC TCCAAGCTGACCGTGGACAAGAGCCGGTGGCAGGAAGGCAACGTGTTCAGCTGCTCCGTGATGCACGAGGCCCTGC ACAACCACTACACCCAGAAGTCCCTGTCTCTGTCCCTGGGC |
| | 4 | 565 | TACATCCACGTGACCCAGAGCCCCAGCAGCCTGTCCGTGTCCATCGGCGACAGAGTGACCATCAACTGCCAGACCTC TCAGGGCGTGGGCAGCGACCTGCACTGGTATCAGCACAAGCCTGGCAGAGCCCCCAAGCTGCTGATCCACCACACA AGCAGCTCCGAAGAGGGCGTGCCCAGCAGATTTTCCGGCAGCGGCTTCCACACCAGCTTCAACCTGACCATCAGCGA TCTGCAGGCCGACGACATTGCCACCTACTATTGTCAGGTGCTGCAGTTCTTCGGCAGAGGCAGCAGACTGCACATCA AGCGTACGGTGGCCGCTCCCAGCGTGTTCATCTTCCCACCTAGCGACGAGCAGCTGAAGTCCGGCACAGCCTCTGTC GTGTGCCTGCTGAACAACTTCTACCCCCGCGAGGCCAAAGTGCAGTGGAAGGTGGACAACGCCCTGCAGAGCGGCA ACAGCCAGGAAAGCGTGACCGAGCAGGACAGCAAGGACTCCACCTACAGCCTGAGCAGCACCCTGACACTGAGCAA GGCCGACTACGAGAAGCACAAGGTGTACGCCTGCGAAGTGACCCACCAGGGCCTGTCTAGCCCCGTGACCAAGAGC TTCAACCGGGGCGAGTGT |
| Trispecific 27 N6_rw52/ CD28sup x CD3mid_ ENLF IgG1_NNAS_ DKTHT linker | 1 | 566 | GACATCGTGATGACCCAGACCCCCCTGAGCCTGAGCGTGACACCTGGACAGCCTGCCAGCATCAGCTGCAAGAGCA GCCAGAGCCTGGTGCACGAGAACCTGTTCACCTACCTGAGCTGGTATCTGCAGAAGCCCGGCCAGAGCCCCCAGTCC CTGATCTACAAGGTGTCCAACAGATTCAGCGGCGTGCCCGACAGATTCTCCGGCAGCGGCTCTGGCACCGACTTCAC CCTGAAGATCAGCCGGGTGGAAGCCGAGGACGTGGGCGTGTACTATTGTGGCCAGGGCACCCAGTACCCCTTCACCT TTGGCAGCGGCACCAAGGTGGAAATCAAGGACAAAACCCATACCGACATCCAGATGACCCAGAGCCCCAGCAGCCT GTCTGCCAGCGTGGGCGACAGAGTGACCATCACCTGTCAGGCCAGCCAGAACATCTACGTGTGGCTGAACTGGTATC AGCAGAAGCCCGGCAAGGCCCCCAAGCTGCTGATCTACAAGGCCAGCAACCTGCACACCGGCGTGCCCAGCAGATT TTCTGGCAGCGGCTCCGGCACCGACTTCACCCTGACAATCAGCTCCCTGCAGCCCGAGGACATTGCCACCTACTACT GCCAGCAGGGCCAGACCTACCCCTACACCTTTGGCCAGGGCACCAAGCTGGAAATCAAGGATAAGACCCACACCCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| | 2 | 567 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG |

TABLE 5-continued

| Trispecific binding protein polynucleotide sequences | | | |
|---|---|---|---|
| Molecule | Polypeptide Number (acc. to formula) | SEQ ID NO | Sequence |
| | | | CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCCAGCGTGTTCCCTCTGGCCCCTAGCAGCAAGAGCACATCTGGCGGAACAGCCGCCCTGGGCTGCCTCGTGAAG<br>GACTACTTTCCCGAGCCCGTGACCGTGTCCTGGAATTCTGGCGCCCTGACCAGCGGCGTGCACACCTTTCCAGCTGTG<br>CTGCAGTCCAGCGGCCTGTACAGCCTGAGCAGCGTCGTGACAGTGCCCAGCAGCTCTCTGGGCACCCAGACCTACAT<br>CTGCAACGTGAACCACAAGCCCAGCAACACCAAGGTGGACAAGAAGGTGGAACCCAAGAGCTGCGACAAGACCCA<br>CACCTGTCCCCCTTGTCCTGCCCCCGAACTGCTGGGAGGCCCTTCCGTGTTCCTGTTCCCCCCAAAGCCCAAGGACAC<br>CCTGATGATCAGCCGGACCCCCGAAGTGACCTGCGTGGTGGTGGATGTGTCCCACGAGGACCCTGAAGTGAAGTTCA<br>ATTGGTACGTGGACGGCGTGGAAGTGCACAACGCCAAGACCAAGCCAAGAGAGGAACAGTACAACAATGCCTCCCG<br>GGTGGTGTCCGTGCTGACCGTGCTGCACCAGGACTGGCTGAACGGCAAAGAGTACAAGTGCAAGGTGTCCAACAAG<br>GCCCTGCCTGCCCCCATCGAGAAAACCATCAGCAAGGCCAAGGGCCAGCCCCGCGAACCCCAGGTGTGCACACTGC<br>CCCCAAGCAGGGACGAGCTGACCAAGAACCAGGTGTCCCTGAGCTGTGCCGTGAAAGGCTTCTACCCCTCCGATATC<br>GCCGTGGAATGGGAGAGCAACGGCCAGCCCGAGAACAACTACAAGACCACCCCCCCTGTGCTGGACAGCGACGGCT<br>CATTCTTCCTGGTGTCCAAGCTGACAGTGGACAAGTCCCGGTGGCAGCAGGGCAACGTGTTCAGCTGCTCCGTGATG<br>CACGAGGCCCTGCACAACCACTACACCCAGAAGTCCCTGAGCCTGAGCCCCGGC |
| | 3 | 568 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCACCAACTTCGGCGGAGGCTTCCGGGATAGAGTGACCCTGACCCGGGACGTGTACCGCG<br>AGATCGCCTACATGGACATCCGGGGCCTGAAGCCCGATGACACCGCCGTGTACTACTGCGCCAGAGACAGAAGCTA<br>CGGCGACAGCAGCTGGGCTCTGGATGCTTGGGGCCAGGGCACAACCGTGGTGGTGTCTGCCGCCTCTACAAAGGGCC<br>CATCGGTCTTCCCCCTGGCACCCTCCTCCAAGAGCACCTCTGGGGGCACAGCGGCCCTGGGCTGCCTGGTCAAGGAC<br>TACTTCCCCGAACCGGTGACGGTGTCGTGGAACTCAGGCGCCCTGACCAGCGGCGTGCACACCTTCCCGGCTGTCCT<br>ACAGTCCTCAGGACTCTACTCCCTCAGCAGCGTGGTGACCGTGCCCTCCAGCAGCTTGGGCACCCAGACCTACATCT<br>GCAACGTGAATCACAAGCCCAGCAACACCAAGGTGGACAAGAAAGTTGAGCCCAAATCTTGTGACAAAACTCACAC<br>ATGCCCACCGTGCCCAGCACCTGAACTCCTGGGGGGACCGTCAGTCTTCCTCTTCCCCCCAAAACCCAAGGACACCC<br>TCATGATCTCCCGGACCCCTGAGGTCACATGCGTGGTGGTGGACGTGAGCCACGAAGACCCTGAGGTCAAGTTCAAC<br>TGGTATGTTGACGGCGTGGAGGTGCATAATGCCAAGACAAAGCCGCGGGAGGAGCAGTACAACAATGCCTCCCGTG<br>TGGTCAGCGTCCTCACCGTCCTGCACCAGGACTGGCTGAATGGCAAGGAGTACAAGTGCAAGGTCTCCAACAAAGCC<br>CTCCCAGCCCCCATCGAGAAAACCATCTCCAAAGCCAAAGGGCAGCCCCGAGAACCACAGGTGTACACCCTGCCCC<br>CATGCCGGGATGAGCTGACCAAGAATCAAGTCAGCCTGTGGTGCCTGGTAAAAGGCTTCTATCCCAGCGACATCGCC<br>GTGGAGTGGGAGAGCAATGGGCAGCCGGAGAACAACTACAAGACCACGCCTCCCGTGCTGGACTCCGACGGCTCCT<br>TCTTCCTCTACTCAAAACTCACCGTGGACAAGAGCAGGTGGCAGCAGGGGAACGTCTTCTCATGCTCCGTGATGCAT<br>GAGGCTCTGCACAACCACTACACGCAGAAGAGCCTCTCCCTGTCTCCGGGT |
| | 4 | 569 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCTCCGAAGAGGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA |

TABLE 5-continued

Trispecific binding protein polynucleotide sequences

| Molecule | Polypeptide Number (acc. to formula) | SEQ ID NO | Sequence |
|---|---|---|---|
| | | | ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 28 N6_FR3-03/ CD28sup x CD3mid_ ENLQ IgG4 FALA/409K_ DKTHT linker | 1 | 570 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 571 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC<br>CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC<br>GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 572 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGATGGATC<br>AAGCCCCAGTATGGCGCCGTGAACTTCGGCGGAGGCTTCCGGGATAGAGTGACCCTGACCCGGCAGCTGAGCCAGG |

TABLE 5-continued

| Molecule | Polypeptide Number (acc. to formula) | SEQ ID NO | Sequence |
|---|---|---|---|
| Trispecific binding protein polynucleotide sequences | | | |
| | | | ACCCTGATGATCCGGATTGGGGCATCGCCTACATGGACATCCGGGGCCTGAAGCCCGATGACACCGCCGTGTACTAC<br>TGCGCCAGAGACAGAAGCTACGGCGACAGCAGCTGGGCTCTGGATGCTTGGGGCCAGGGCACAACCGTGGTGGTGT<br>CTGCCGCCTCTACAAAGGGCCCATCGGTGTTCCCTCTGGCCCCTTGCAGCAGAAGCACCAGCGAATCTACAGCCGCC<br>NTGGGCTGCCTCGTGAAGGACTACTTTCCCGAGCCCGTGACCGTGTCCTGGAACTCTGGCGCTCTGACAAGCGGCGT<br>GCACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTAA<br>GTACGGCCCTCCCTGCCCTCCTTGCCCAGCCCCTGAAGCTGCCGGCGGACCCTCCGTGTTCCTGTTCCCCCCAAAGCC<br>CAAGGACACCCTGATGATCAGCCGGACCCCCGAAGTGACCTGCGTGGTGGTGGATGTGTCCCAGGAAGATCCCGAG<br>GTGCAGTTCAATTGGTACGTGGACGGCGTGGAAGTGCACAACGCCAAGACCAAGCCCAGAGAGGAACAGTTCAACA<br>GCACCTACCGGGTGGTGTCCGTGCTGACCGTGCTGCACCAGGACTGGCTGAACGGCAAAGAGTACAAGTGCAAGGT<br>GTCCAACAAGGGCCTGCCCAGCTCCATCGAGAAAACCATCAGCAAGGCCAAGGGCCAGCCCCGCGAGCCTCAAGTG<br>TATACCCTGCCCCCTTGCCAGGAAGAGATGACCAAGAACCAGGTGTCCCTGTGGTGTCTCGTGAAAGGCTTCTACCC<br>CAGCGACATTGCCGTGGAATGGGAGAGCAACGGCCAGCCCGAGAACAACTACAAGACCACCCCCCCTGTGCTGGAC<br>AGCGACGGCTCATTCTTCCTGTACTCCAAGCTGACCGTGGACAAGAGCCGGTGGCAGGAAGGCAACGTGTTCAGCTG<br>CTCCGTGATGCACGAGGCCCTGCACAACCACTACACCCAGAAGTCCCTGTCTCTGTCCCTGGGC |
| | 4 | 573 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |
| Trispecific 29<br>N6_FR3-03/<br>CD28sup x<br>CD3mid_<br>ENLF IgG4<br>FALA/409K_<br>DKTHT linker | 1 | 574 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGTTCACCTACCTGAGCTGGTATCTGCAGAAGCCCGGCCAGAGCCCCCAGTCC<br>CTGATCTACAAGGTGTCCAACAGATTCAGCGGCGTGCCCGACAGATTCTCCGGCAGCGGCTCTGGCACCGACTTCAC<br>CCTGAAGATCAGCCGGGTGGAAGCCGAGGACGTGGGCGTGTACTATTGTGGCCAGGGCACCCAGTACCCCTTCACCT<br>TTGGCAGCGGCACCAAGGTGGAAATCAAGGACAAAACCCATACCGACATCCAGATGACCCAGAGCCCCAGCAGCCT<br>GTCTGCCAGCGTGGGCGACAGAGTGACCATCACCTGTCAGGCCAGCCAGAACATCTACGTGTGGCTGAACTGGTATC<br>AGCAGAAGCCCGGCAAGGCCCCCAAGCTGCTGATCTACAAGGCCAGCAACCTGCACACCGGCGTGCCCAGCAGATT<br>TTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 575 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA |

TABLE 5-continued

| Molecule | Polypeptide Number (acc. to formula) | SEQ ID NO | Sequence |
|---|---|---|---|
| | | | Trispecific binding protein polynucleotide sequences |
| | | | GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC<br>CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC<br>GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 576 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGCAGCTGAGCCAGG<br>ACCCTGATGATCCGGATTGGGGCATCGCCTACATGGACATCCGGGGCCTGAAGCCCGATGACACCGCCGTGTACTAC<br>TGCGCCAGAGACAGAAGCTACGGCGACAGCAGCTGGGCTCTGGATGCTTGGGGCCAGGGCACAACCGTGGTGGTGT<br>CTGCCGCCTCTACAAAGGGCCCATCGGTGTTCCCTCTGGCCCCTTGCAGCAGAAGCACCAGCGAATCTACAGCCGCC<br>NTGGGCTGCCTCGTGAAGGACTACTTTCCCGAGCCCGTGACCGTGTCCTGGAACTCTGGCGCTCTGACAAGCGGCGT<br>GCACACCTTTCCAGCCGTGCTCCAGAGCAGCGGCCTGTACTCTCTGAGCAGCGTCGTGACAGTGCCCAGCAGCAGCC<br>TGGGCACCAAGACCTACACCTGTAACGTGGACCACAAGCCCAGCAACACCAAGGTGGACAAGCGGGTGGAATCTAA<br>GTACGGCCCTCCCTGCCCTCCTTGCCCAGCCCCTGAAGCTGCCGGCGGACCCTCCGTGTTCCTGTTCCCCCCAAAGCC<br>CAAGGACACCCTGATGATCAGCCGGACCCCCGAAGTGACCTGCGTGGTGGTGGATGTGTCCCAGGAAGATCCCGAG<br>GTGCAGTTCAATTGGTACGTGGACGGCGTGGAAGTGCACAACGCCAAGACCAAGCCCAGAGAGGAACAGTTCAACA<br>GCACCTACCGGGTGGTGTCCGTGCTGACCGTGCTGCACCAGGACTGGCTGAACGGCAAAGAGTACAAGTGCAAGGT<br>GTCCAACAAGGGCCTGCCCAGCTCCATCGAGAAAACCATCAGCAAGGCCAAGGGCCAGCCCCGCGAGCCTCAAGTG<br>TATACCCTGCCCCCTTGCCAGGAAGAGATGACCAAGAACCAGGTGTCCCTGTGGTGTCTCGTGAAAGGCTTCTACCC<br>CAGCGACATTGCCGTGGAATGGGAGAGCAACGGCCAGCCCGAGAACAACTACAAGACCACCCCCCCTGTGCTGGAC<br>AGCGACGGCTCATTCTTCCTGTACTCCAAGCTGACCGTGGACAAGAGCCGGTGGCAGGAAGGCAACGTGTTCAGCTG<br>CTCCGTGATGCACGAGGCCCTGCACAACCACTACACCCAGAAGTCCCTGTCTCTGTCCCTGGGC |
| | 4 | 577 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC |

TABLE 5-continued

Trispecific binding protein polynucleotide sequences

| Molecule | Polypeptide Number (acc. to formula) | SEQ ID NO | Sequence |
|---|---|---|---|
| | | | TTCAACCGGGGCGAGTGT |
| Trispecific 30 N6_FR3-03/ CD28sup x CD3mid_ ENLQIgG1_ NNAS_ DKTHT linker | 1 | 578 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 579 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCCAGCGTGTTCCCTCTGGCCCCTAGCAGCAAGAGCACATCTGGCGGAACAGCCGCCCTGGGCTGCCTCGTGAAG<br>GACTACTTTCCCGAGCCCGTGACCGTGTCCTGGAATTCTGGCGCCCTGACCAGCGGCGTGCACACCTTTCCAGCTGTG<br>CTGCAGTCCAGCGGCCTGTACAGCCTGAGCAGCGTCGTGACAGTGCCCAGCAGCTCTCTGGGCACCCAGACCTACAT<br>CTGCAACGTGAACCACAAGCCCAGCAACACCAAGGTGGACAAGAAGGTGGAACCCAAGAGCTGCGACAAGACCCA<br>CACCTGTCCCCCTTGTCCTGCCCCCGAACTGCTGGGAGGCCCTTCCGTGTTCCTGTTCCCCCCAAAGCCCAAGGACAC<br>CCTGATGATCAGCCGGACCCCCGAAGTGACCTGCGTGGTGGTGGATGTGTCCCACGAGGACCCTGAAGTGAAGTTCA<br>ATTGGTACGTGGACGGCGTGGAAGTGCACAACGCCAAGACCAAGCCAAGAGAGGAACAGTACAACAATGCCTCCCG<br>GGTGGTGTCCGTGCTGACCGTGCTGCACCAGGACTGGCTGAACGGCAAAGAGTACAAGTGCAAGGTGTCCAACAAG<br>GCCCTGCCTGCCCCCATCGAGAAAACCATCAGCAAGGCCAAGGGCCAGCCCCGCGAACCCCAGGTGTGCACACTGC<br>CCCCAAGCAGGGACGAGCTGACCAAGAACCAGGTGTCCCTGAGCTGTGCCGTGAAAGGCTTCTACCCCTCCGATATC<br>GCCGTGGAATGGGAGAGCAACGGCCAGCCCGAGAACAACTACAAGACCACCCCCCCTGTGCTGGACAGCGACGGCT<br>CATTCTTCCTGGTGTCCAAGCTGACAGTGGACAAGTCCCGGTGGCAGCAGGGCAACGTGTTCAGCTGCTCCGTGATG<br>CACGAGGCCCTGCACAACCACTACACCCAGAAGTCCCTGAGCCTGAGCCCCGGC |
| | 3 | 580 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGCAGCTGAGCCAGG<br>ACCCTGATGATCCGGATTGGGGCATCGCCTACATGGACATCCGGGGCCTGAAGCCCGATGACACCGCCGTGTACTAC<br>TGCGCCAGAGACAGAAGCTACGGCGACAGCAGCTGGGCTCTGGATGCTTGGGGCCAGGGCACAACCGTGGTGGTGT |

TABLE 5-continued

| Trispecific binding protein polynucleotide sequences | | | |
|---|---|---|---|
| Molecule | Polypeptide Number (acc. to formula) | SEQ ID NO | Sequence |
| | | | CTGCCGCCTCTACAAAGGGCCCATCGGTCTTCCCCCTGGCACCCTCCTCCAAGAGCACCTCTGGGGGCACAGCGGCC CTGGGCTGCCTGGTCAAGGACTACTTCCCCGAACCGGTGACGGTGTCGTGGAACTCAGGCGCCCTGACCAGCGGCGT GCACACCTTCCCGGCTGTCCTACAGTCCTCAGGACTCTACTCCCTCAGCAGCGTGGTGACCGTGCCCTCCAGCAGCTT GGGCACCCAGACCTACATCTGCAACGTGAATCACAAGCCCAGCAACACCAAGGTGGACAAGAAAGTTGAGCCCAAA TCTTGTGACAAAACTCACACATGCCCACCGTGCCCAGCACCTGAACTCCTGGGGGGACCGTCAGTCTTCCTCTTCCCC CCAAAACCCAAGGACACCCTCATGATCTCCCGGACCCCTGAGGTCACATGCGTGGTGGTGGACGTGAGCCACGAAG ACCCTGAGGTCAAGTTCAACTGGTATGTTGACGGCGTGGAGGTGCATAATGCCAAGACAAAGCCGCGGGAGGAGCA GTACAACAATGCCTCCCGTGTGGTCAGCGTCCTCACCGTCCTGCACCAGGACTGGCTGAATGGCAAGGAGTACAAGT GCAAGGTCTCCAACAAAGCCCTCCCAGCCCCCATCGAGAAAACCATCTCCAAAGCCAAAGGGCAGCCCCGAGAACC ACAGGTGTACACCCTGCCCCCATGCCGGGATGAGCTGACCAAGAATCAAGTCAGCCTGTGGTGCCTGGTAAAAGGCT TCTATCCCAGCGACATCGCCGTGGAGTGGGAGAGCAATGGGCAGCCGGAGAACAACTACAAGACCACGCCTCCCGT GCTGGACTCCGACGGCTCCTTCTTCCTCTACTCAAAACTCACCGTGGACAAGAGCAGGTGGCAGCAGGGGAACGTCT TCTCATGCTCCGTGATGCATGAGGCTCTGCACAACCACTACACGCAGAAGAGCCTCTCCCTGTCTCCGGGT |
| | 4 | 581 | TACATCCACGTGACCCAGAGCCCCAGCAGCCTGTCCGTGTCCATCGGCGACAGAGTGACCATCAACTGCCAGACCTC TCAGGGCGTGGGCAGCGACCTGCACTGGTATCAGCACAAGCCTGGCAGAGCCCCCAAGCTGCTGATCCACCACACA AGCAGCGTGGAAGATGGCGTGCCCAGCAGATTTTCCGGCAGCGGCTTCCACACCAGCTTCAACCTGACCATCAGCGA TCTGCAGGCCGACGACATTGCCACCTACTATTGTCAGGTGCTGCAGTTCTTCGGCAGAGGCAGCAGACTGCACATCA AGCGTACGGTGGCCGCTCCCAGCGTGTTCATCTTCCCACCTAGCGACGAGCAGCTGAAGTCCGGCACAGCCTCTGTC GTGTGCCTGCTGAACAACTTCTACCCCCGCGAGGCCAAAGTGCAGTGGAAGGTGGACAACGCCCTGCAGAGCGGCA ACAGCCAGGAAAGCGTGACCGAGCAGGACAGCAAGGACTCCACCTACAGCCTGAGCAGCACCCTGACACTGAGCAA GGCCGACTACGAGAAGCACAAGGTGTACGCCTGCGAAGTGACCCACCAGGGCCTGTCTAGCCCCGTGACCAAGAGC TTCAACCGGGGCGAGTGT |
| Trispecific 31 N6_FR3-03/ CD28sup x CD3mid_ ENLF IgG1_NNAS_ DKTHT linker | 1 | 582 | GACATCGTGATGACCCAGACCCCCCTGAGCCTGAGCGTGACACCTGGACAGCCTGCCAGCATCAGCTGCAAGAGCA GCCAGAGCCTGGTGCACGAGAACCTGTTCACCTACCTGAGCTGGTATCTGCAGAAGCCCGGCCAGAGCCCCCAGTCC CTGATCTACAAGGTGTCCAACAGATTCAGCGGCGTGCCCGACAGATTCTCCGGCAGCGGCTCTGGCACCGACTTCAC CCTGAAGATCAGCCGGGTGGAAGCCGAGGACGTGGGCGTGTACTATTGTGGCCAGGGCACCCAGTACCCCTTCACCT TTGGCAGCGGCACCAAGGTGGAAATCAAGGACAAAACCCATACCGACATCCAGATGACCCAGAGCCCCAGCAGCCT GTCTGCCAGCGTGGGCGACAGAGTGACCATCACCTGTCAGGCCAGCCAGAACATCTACGTGTGGCTGAACTGGTATC AGCAGAAGCCCGGCAAGGCCCCCAAGCTGCTGATCTACAAGGCCAGCAACCTGCACACCGGCGTGCCCAGCAGATT TTCTGGCAGCGGCTCCGGCACCGACTTCACCCTGACAATCAGCTCCCTGCAGCCCGAGGACATTGCCACCTACTACT GCCAGCAGGGCCAGACCTACCCCTACACCTTTGGCCAGGGCACCAAGCTGGAAATCAAGGATAAGACCCACACCCG TACGGTGGCCGCTCCCAGCGTGTTCATCTTCCCACCTAGCGACGAGCAGCTGAAGTCCGGCACAGCCTCTGTCGTGT GCCTGCTGAACAACTTCTACCCCCGCGAGGCCAAAGTGCAGTGGAAGGTGGACAACGCCCTGCAGAGCGGCAACAG CCAGGAAAGCGTGACCGAGCAGGACAGCAAGGACTCCACCTACAGCCTGAGCAGCACCCTGACACTGAGCAAGGCC GACTACGAGAAGCACAAGGTGTACGCCTGCGAAGTGACCCACCAGGGCCTGTCTAGCCCCGTGACCAAGAGCTTCA ACCGGGGCGAGTGT |
| | 2 | 583 | CAGGTGCAGCTGGTGCAGTCTGGCGCCGAGGTCGTGAAACCTGGCGCCTCTGTGAAGGTGTCCTGCAAGGCCAGCGG CTACACCTTTACCAGCTACTACATCCACTGGGTGCGCCAGGCCCCTGGACAGGGACTGGAATGGATCGGCAGCATCT ACCCCGGCAACGTGAACACCAACTACGCCCAGAAGTTCCAGGGCAGAGCCACCCTGACCGTGGACACCAGCATCAG CACCGCCTACATGGAACTGAGCCGGCTGAGAAGCGACGACACCGCCGTGTACTACTGCACCCGGTCCCACTACGGCC TGGATTGGAACTTCGACGTGTGGGGCAAGGGCACCACCGTGACAGTGTCTAGCGACAAAACCCATACCCAGGTGCA GCTGGTGGAATCTGGCGGCGGAGTGGTGCAGCCTGGCAGAAGCCTGAGACTGAGCTGTGCCGCCAGCGGCTTCACCT TCACCAAGGCCTGGATGCACTGGGTGCGCCAGGCCCCTGGAAAGCAGCTGGAATGGGTGGCCCAGATCAAGGACAA |

TABLE 5-continued

Trispecific binding protein polynucleotide sequences

| Molecule | Polypeptide Number (acc. to formula) | SEQ ID NO | Sequence |
|---|---|---|---|
| | | | GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCCAGCGTGTTCCCTCTGGCCCCTAGCAGCAAGAGCACATCTGGCGGAACAGCCGCCCTGGGCTGCCTCGTGAAG<br>GACTACTTTCCCGAGCCCGTGACCGTGTCCTGGAATTCTGGCGCCCTGACCAGCGGCGTGCACACCTTTCCAGCTGTG<br>CTGCAGTCCAGCGGCCTGTACAGCCTGAGCAGCGTCGTGACAGTGCCCAGCAGCTCTCTGGGCACCCAGACCTACAT<br>CTGCAACGTGAACCACAAGCCCAGCAACACCAAGGTGGACAAGAAGGTGGAACCCAAGAGCTGCGACAAGACCCA<br>CACCTGTCCCCCTTGTCCTGCCCCCGAACTGCTGGGAGGCCCTTCCGTGTTCCTGTTCCCCCCAAAGCCCAAGGACAC<br>CCTGATGATCAGCCGGACCCCCGAAGTGACCTGCGTGGTGGTGGATGTGTCCCACGAGGACCCTGAAGTGAAGTTCA<br>ATTGGTACGTGGACGGCGTGGAAGTGCACAACGCCAAGACCAAGCCAAGAGAGGAACAGTACAACAATGCCTCCCG<br>GGTGGTGTCCGTGCTGACCGTGCTGCACCAGGACTGGCTGAACGGCAAAGAGTACAAGTGCAAGGTGTCCAACAAG<br>GCCCTGCCTGCCCCCATCGAGAAAACCATCAGCAAGGCCAAGGGCCAGCCCCGCGAACCCCAGGTGTGCACACTGC<br>CCCCAAGCAGGGACGAGCTGACCAAGAACCAGGTGTCCCTGAGCTGTGCCGTGAAAGGCTTCTACCCCTCCGATATC<br>GCCGTGGAATGGGAGAGCAACGGCCAGCCCGAGAACAACTACAAGACCACCCCCCCTGTGCTGGACAGCGACGGCT<br>CATTCTTCCTGGTGTCCAAGCTGACAGTGGACAAGTCCCGGTGGCAGCAGGGCAACGTGTTCAGCTGCTCCGTGATG<br>CACGAGGCCCTGCACAACCACTACACCCAGAAGTCCCTGAGCCTGAGCCCCGGC |
| | 3 | 584 | AGAGCCCACCTGGTGCAGTCTGGCACCGCCATGAAGAAACCAGGCGCCTCTGTGCGGGTGTCCTGTCAGACAAGCG<br>GCTACACCTTCACCGCCCACATCCTGTTCTGGTTCCGGCAGGCCCCTGGCAGAGGACTGGAATGGGTGGGATGGATC<br>AAGCCCCAGTATGGCGCCGTGAACTTCGGCGGAGGCTTCCGGGATAGAGTGACCCTGACCCGGCAGCTGAGCCAGG<br>ACCCTGATGATCCGGATTGGGGCATCGCCTACATGGACATCCGGGGCCTGAAGCCCGATGACACCGCCGTGTACTAC<br>TGCGCCAGAGACAGAAGCTACGGCGACAGCAGCTGGGCTCTGGATGCTTGGGGCCAGGGCACAACCGTGGTGGTGT<br>CTGCCGCCTCTACAAAGGGCCCATCGGTCTTCCCCCTGGCACCCTCCTCCAAGAGCACCTCTGGGGGCACAGCGGCC<br>CTGGGCTGCCTGGTCAAGGACTACTTCCCCGAACCGGTGACGGTGTCGTGGAACTCAGGCGCCCTGACCAGCGGCGT<br>GCACACCTTCCCGGCTGTCCTACAGTCCTCAGGACTCTACTCCCTCAGCAGCGTGGTGACCGTGCCCTCCAGCAGCTT<br>GGGCACCCAGACCTACATCTGCAACGTGAATCACAAGCCCAGCAACACCAAGGTGGACAAGAAAGTTGAGCCCAAA<br>TCTTGTGACAAAACTCACACATGCCCACCGTGCCCAGCACCTGAACTCCTGGGGGGACCGTCAGTCTTCCTCTTCCCC<br>CCAAAACCCAAGGACACCCTCATGATCTCCCGGACCCCTGAGGTCACATGCGTGGTGGTGGACGTGAGCCACGAAG<br>ACCCTGAGGTCAAGTTCAACTGGTATGTTGACGGCGTGGAGGTGCATAATGCCAAGACAAAGCCGCGGGAGGAGCA<br>GTACAACAATGCCTCCCGTGTGGTCAGCGTCCTCACCGTCCTGCACCAGGACTGGCTGAATGGCAAGGAGTACAAGT<br>GCAAGGTCTCCAACAAAGCCCTCCCAGCCCCCATCGAGAAAACCATCTCCAAAGCCAAAGGGCAGCCCCGAGAACC<br>ACAGGTGTACACCCTGCCCCCATGCCGGGATGAGCTGACCAAGAATCAAGTCAGCCTGTGGTGCCTGGTAAAAGGCT<br>TCTATCCCAGCGACATCGCCGTGGAGTGGGAGAGCAATGGGCAGCCGGAGAACAACTACAAGACCACGCCTCCCGT<br>GCTGGACTCCGACGGCTCCTTCTTCCTCTACTCAAAACTCACCGTGGACAAGAGCAGGTGGCAGCAGGGGAACGTCT<br>TCTCATGCTCCGTGATGCATGAGGCTCTGCACAACCACTACACGCAGAAGAGCCTCTCCCTGTCTCCGGGT |
| | 4 | 585 | TACATCCACGTGACCCAGAGCCCCAGCAGCCTGTCCGTGTCCATCGGCGACAGAGTGACCATCAACTGCCAGACCTC<br>TCAGGGCGTGGGCAGCGACCTGCACTGGTATCAGCACAAGCCTGGCAGAGCCCCCAAGCTGCTGATCCACCACACA<br>AGCAGCGTGGAAGATGGCGTGCCCAGCAGATTTTCCGGCAGCGGCTTCCACACCAGCTTCAACCTGACCATCAGCGA<br>TCTGCAGGCCGACGACATTGCCACCTACTATTGTCAGGTGCTGCAGTTCTTCGGCAGAGGCAGCAGACTGCACATCA<br>AGCGTACGGTGGCCGCTCCCAGCGTGTTCATCTTCCCACCTAGCGACGAGCAGCTGAAGTCCGGCACAGCCTCTGTC<br>GTGTGCCTGCTGAACAACTTCTACCCCCGCGAGGCCAAAGTGCAGTGGAAGGTGGACAACGCCCTGCAGAGCGGCA<br>ACAGCCAGGAAAGCGTGACCGAGCAGGACAGCAAGGACTCCACCTACAGCCTGAGCAGCACCCTGACACTGAGCAA<br>GGCCGACTACGAGAAGCACAAGGTGTACGCCTGCGAAGTGACCCACCAGGGCCTGTCTAGCCCCGTGACCAAGAGC<br>TTCAACCGGGGCGAGTGT |

TABLE 5-continued

| Trispecific binding protein polynucleotide sequences | | | |
|---|---|---|---|
| Molecule | Polypeptide Number (acc. to formula) | SEQ ID NO | Sequence |
| Trispecific 34 VRC01.23/ CD28sup x CD3mid_ ENLQ IgG4 FALA/409K_ DKTHT linker | 1 | 586 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGCAGACCTACCTGAGCTGGTATCTGCAGAAGCCCGGCCAGAGCCCCCAGTC<br>CCTGATCTACAAGGTGTCCAACAGATTCAGCGGCGTGCCCGACAGATTCTCCGGCAGCGGCTCTGGCACCGACTTCA<br>CCCTGAAGATCAGCCGGGTGGAAGCCGAGGACGTGGGCGTGTACTATTGTGGCCAGGGCACCCAGTACCCCTTCACC<br>TTTGGCAGCGGCACCAAGGTGGAAATCAAGGACAAAACCCATACCGACATCCAGATGACCCAGAGCCCCAGCAGCC<br>TGTCTGCCAGCGTGGGCGACAGAGTGACCATCACCTGTCAGGCCAGCCAGAACATCTACGTGTGGCTGAACTGGTAT<br>CAGCAGAAGCCCGGCAAGGCCCCCAAGCTGCTGATCTACAAGGCCAGCAACCTGCACACCGGCGTGCCCAGCAGAT<br>TTTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 587 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT<br>GAGCCCCTTCGATTACTGGGGCCAGGGAACCCTCGTGACCGTGTCTAGTGATAAGACCCACACCGCCAGCACAAAGG<br>GCCCATCGGTGTTCCCTCTGGCCCCTTGCAGCAGAAGCACCAGCGAATCTACAGCCGCCCTGGGCTGCCTCGTGAAG<br>GACTACTTTCCCGAGCCCGTGACCGTGTCCTGGAACTCTGGCGCTCTGACAAGCGGCGTGCACACCTTTCCAGCCGTG<br>CTCCAGAGCAGCGGCCTGTACTCTCTGAGCAGCGTCGTGACAGTGCCCAGCAGCAGCCTGGGCACCAAGACCTACAC<br>CTGTAACGTGGACCACAAGCCCAGCAACACCAAGGTGGACAAGCGGGTGGAATCTAAGTACGGCCCTCCCTGCCCT<br>CCTTGCCCAGCCCCTGAAGCTGCCGGCGGACCCTCCGTGTTCCTGTTCCCCCCAAAGCCCAAGGACACCCTGATGATC<br>AGCCGGACCCCCGAAGTGACCTGCGTGGTGGTGGATGTGTCCCAGGAAGATCCCGAGGTGCAGTTCAATTGGTACGT<br>GGACGGCGTGGAAGTGCACAACGCCAAGACCAAGCCCAGAGAGGAACAGTTCAACAGCACCTACCGGGTGGTGTCC<br>GTGCTGACCGTGCTGCACCAGGACTGGCTGAACGGCAAAGAGTACAAGTGCAAGGTGTCCAACAAGGGCCTGCCCA<br>GCTCCATCGAGAAAACCATCAGCAAGGCCAAGGGCCAGCCCCGCGAGCCTCAAGTGTGTACCCTGCCCCCTAGCCA<br>GGAAGAGATGACCAAGAACCAGGTGTCCCTGAGCTGTGCCGTGAAAGGCTTCTACCCCAGCGACATTGCCGTGGAA<br>TGGGAGAGCAACGGCCAGCCCGAGAACAACTACAAGACCACCCCCCCTGTGCTGGACAGCGACGGCTCATTCTTCCT<br>GGTGTCCAAGCTGACCGTGGACAAGAGCCGGTGGCAGGAAGGCAACGTGTTCAGCTGCTCCGTGATGCACGAGGCC<br>CTGCACAACCACTACACCCAGAAGTCCCTGTCTCTGTCCCTGGGC |
| | 3 | 588 | CAGGTGCAGCTGGTGCAGTCTGGCGGCCAGATGAAGAAACCCGGCGAGAGCATGCGGATCAGCTGCAGAGCCAGCG<br>GCTACGAGTTCATCGACTGCACCCTGAACTGGATCAGACTGGCCCCTGGCAAGCGGCCTGAGTGGATGGGATGGCTG<br>AAGCCTAGATGGGGAGCCGTGAACTACGCCAGACCTCTGCAGGGCAGAGTGACCATGACCCGGCAGCTGAGCCAGG<br>ACCCTGATGATCCGGATTGGGGCACCGCCTTCCTGGAACTGCGGAGCCTGACCGTGGATGATACCGCCGTGTACTTC<br>TGCACCCGGGGCAAGAACTGCGACTACAACTGGGACTTCGAGCACTGGGGCAGAGGCACCCCTGTGATCGTGTCAA<br>GCGCGTCGACCAAGGGCCCATCGGTGTTCCCTCTGGCCCCTTGCAGCAGAAGCACCAGCGAATCTACAGCCGCCNTG<br>GGCTGCCTCGTGAAGGACTACTTTCCCGAGCCCGTGACCGTGTCCTGGAACTCTGGCGNTNTGACAAGCGGCGTGCA |

TABLE 5-continued

| Trispecific binding protein polynucleotide sequences | | | |
|---|---|---|---|
| Molecule | Polypeptide Number (acc. to formula) | SEQ ID NO | Sequence |
| | | | CACCTTTCCAGCCGTGCTCCAGAGCAGCGGCCTGTACTCTCTGAGCAGCGTCGTGACAGTGCCCAGCAGCAGCCTGG<br>GCACCAAGACCTACACCTGTAACGTGGACCACAAGCCCAGCAACACCAAGGTGGACAAGCGGGTGGAATCTAAGTA<br>CGGCCCTCCCTGCCCTCCTTGCCCAGCCCCTGAAGCTGCCGGCGGACCCTCCGTGTTCCTGTTCCCCCCAAAGCCCAA<br>GGACACCCTGATGATCAGCCGGACCCCCGAAGTGACCTGCGTGGTGGTGGATGTGTCCCAGGAAGATCCCGAGGTG<br>CAGTTCAATTGGTACGTGGACGGCGTGGAAGTGCACAACGCCAAGACCAAGCCCAGAGAGGAACAGTTCAACAGCA<br>CCTACCGGGTGGTGTCCGTGCTGACCGTGCTGCACCAGGACTGGCTGAACGGCAAAGAGTACAAGTGCAAGGTGTCC<br>AACAAGGGCCTGCCCAGCTCCATCGAGAAAACCATCAGCAAGGCCAAGGGCCAGCCCCGCGAGCCTCAAGTGTATA<br>CCCTGCCCCCTTGCCAGGAAGAGATGACCAAGAACCAGGTGTCCCTGTGGTGTCTCGTGAAAGGCTTCTACCCCAGC<br>GACATTGCCGTGGAATGGGAGAGCAACGGCCAGCCCGAGAACAACTACAAGACCACCCCCCCTGTGCTGGACAGCG<br>ACGGCTCATTCTTCCTGTACTCCAAGCTGACCGTGGACAAGAGCCGGTGGCAGGAAGGCAACGTGTTCAGCTGCTCC<br>GTGATGCACGAGGCCCTGCACAACCACTACACCCAGAAGTCCCTGTCTCTGTCCCTGGGC |
| | 4 | 589 | CTGACACAGAGCCCTGGCACCCTGTCACTGAGCCCAGGCGAGACAGCCATCATCAGCTGCCGGACAAGCCAGTACG<br>GCAGCCTGGCCTGGTATCAGCAGAGGCCTGGACAGGCCCCCAGACTCGTGATCTACAGCGGCAGCACAAGAGCCGC<br>CGGAATCCCCGATAGATTCAGCGGCTCCAGATGGGGACCCGACTACAACCTGACCATCAGCAACCTGGAAAGCGGC<br>GACTTCGGCGTGTACTACTGCCAGCAGTACGAGTTCTTCGGCCAGGGCACCAAGGTGCAGGTGGACATCAAGCGTAC<br>GGTGGCCGCTCCCAGCGTGTTCATCTTCCCACCTAGCGACGAGCAGCTGAAGTCCGGCACAGCCTCTGTCGTGTGCCT<br>GCTGAACAACTTCTACCCCCGCGAGGCCAAAGTGCAGTGGAAGGTGGACAACGCCCTGCAGAGCGGCAACAGCCAG<br>GAAAGCGTGACCGAGCAGGACAGCAAGGACTCCACCTACAGCCTGAGCAGCACCCTGACACTGAGCAAGGCCGACT<br>ACGAGAAGCACAAGGTGTACGCCTGCGAAGTGACCCACCAGGGCCTGTCTAGCCCCGTGACCAAGAGCTTCAACCG<br>GGGCGAGTGT |
| Trispecific 35<br>VRC01.23/<br>CD28sup x<br>CD3mid_<br>ENLF IgG4<br>FALA/409K_<br>DKTHT linker | 1 | 590 | GACATCGTGATGACCCAGACCCCCCTGAGCCTGAGCGTGACACCTGGACAGCCTGCCAGCATCAGCTGCAAGAGCA<br>GCCAGAGCCTGGTGCACGAGAACCTGTTCACCTACCTGAGCTGGTATCTGCAGAAGCCCGGCCAGAGCCCCCAGTCC<br>CTGATCTACAAGGTGTCCAACAGATTCAGCGGCGTGCCCGACAGATTCTCCGGCAGCGGCTCTGGCACCGACTTCAC<br>CCTGAAGATCAGCCGGGTGGAAGCCGAGGACGTGGGCGTGTACTATTGTGGCCAGGGCACCCAGTACCCCTTCACCT<br>TTGGCAGCGGCACCAAGGTGGAAATCAAGGACAAAACCCATACCGACATCCAGATGACCCAGAGCCCCAGCAGCCT<br>GTCTGCCAGCGTGGGCGACAGAGTGACCATCACCTGTCAGGCCAGCCAGAACATCTACGTGTGGCTGAACTGGTATC<br>AGCAGAAGCCCGGCAAGGCCCCCAAGCTGCTGATCTACAAGGCCAGCAACCTGCACACCGGCGTGCCCAGCAGATT<br>TTCTGGCAGCGGCTCCGGCACCGACTTCACCCTGACAATCAGCTCCCTGCAGCCCGAGGACATTGCCACCTACTACT<br>GCCAGCAGGGCCAGACCTACCCCTACACCTTTGGCCAGGGCACCAAGCTGGAAATCAAGGATAAGACCCACACCCG<br>TACGGTGGCCGCTCCCAGCGTGTTCATCTTCCCACCTAGCGACGAGCAGCTGAAGTCCGGCACAGCCTCTGTCGTGT<br>GCCTGCTGAACAACTTCTACCCCCGCGAGGCCAAAGTGCAGTGGAAGGTGGACAACGCCCTGCAGAGCGGCAACAG<br>CCAGGAAAGCGTGACCGAGCAGGACAGCAAGGACTCCACCTACAGCCTGAGCAGCACCCTGACACTGAGCAAGGCC<br>GACTACGAGAAGCACAAGGTGTACGCCTGCGAAGTGACCCACCAGGGCCTGTCTAGCCCCGTGACCAAGAGCTTCA<br>ACCGGGGCGAGTGT |
| | 2 | 591 | CAGGTGCAGCTGGTGCAGTCTGGCGCCGAGGTCGTGAAACCTGGCGCCTCTGTGAAGGTGTCCTGCAAGGCCAGCGG<br>CTACACCTTTACCAGCTACTACATCCACTGGGTGCGCCAGGCCCCTGGACAGGGACTGGAATGGATCGGCAGCATCT<br>ACCCCGGCAACGTGAACACCAACTACGCCCAGAAGTTCCAGGGCAGAGCCACCCTGACCGTGGACACCAGCATCAG<br>CACCGCCTACATGGAACTGAGCCGGCTGAGAAGCGACGACACCGCCGTGTACTACTGCACCCGGTCCCACTACGGCC<br>TGGATTGGAACTTCGACGTGTGGGGCAAGGGCACCACCGTGACAGTGTCTAGCGACAAAACCCATACCCAGGTGCA<br>GCTGGTGGAATCTGGCGGCGGAGTGGTGCAGCCTGGCAGAAGCCTGAGACTGAGCTGTGCCGCCAGCGGCTTCACCT<br>TCACCAAGGCCTGGATGCACTGGGTGCGCCAGGCCCCTGGAAAGCAGCTGGAATGGGTGGCCCAGATCAAGGACAA<br>GAGCAACAGCTACGCCACCTACTACGCCGACAGCGTGAAGGGCCGGTTCACCATCAGCCGGGACGACAGCAAGAAC<br>ACCCTGTACCTGCAGATGAACAGCCTGCGGGCCGAGGACACCGCCGTGTACTACTGTCGGGGCGTGTACTATGCCCT |

TABLE 5-continued

Trispecific binding protein polynucleotide sequences

| Molecule | Polypeptide Number (acc. to formula) | SEQ ID NO | Sequence |
|---|---|---|---|
| | | | GAGCCCCTTCGATTACTGGGGCCAGGGAACCCTCGTGACCGTGTCTAGTGATAAGACCCACACCGCCAGCACAAAGG GCCCATCGGTGTTCCCTCTGGCCCCTTGCAGCAGAAGCACCAGCGAATCTACAGCCGCCCTGGGCTGCCTCGTGAAG GACTACTTTCCCGAGCCCGTGACCGTGTCCTGGAACTCTGGCGCTCTGACAAGCGGCGTGCACACCTTTCCAGCCGTG CTCCAGAGCAGCGGCCTGTACTCTCTGAGCAGCGTCGTGACAGTGCCCAGCAGCAGCCTGGGCACCAAGACCTACAC CTGTAACGTGGACCACAAGCCCAGCAACACCAAGGTGGACAAGCGGGTGGAATCTAAGTACGGCCCTCCCTGCCCT CCTTGCCCAGCCCCTGAAGCTGCCGGCGGACCCTCCGTGTTCCTGTTCCCCCCAAAGCCCAAGGACACCCTGATGATC AGCCGGACCCCCGAAGTGACCTGCGTGGTGGTGGATGTGTCCCAGGAAGATCCCGAGGTGCAGTTCAATTGGTACGT GGACGGCGTGGAAGTGCACAACGCCAAGACCAAGCCCAGAGAGGAACAGTTCAACAGCACCTACCGGGTGGTGTCC GTGCTGACCGTGCTGCACCAGGACTGGCTGAACGGCAAAGAGTACAAGTGCAAGGTGTCCAACAAGGGCCTGCCCA GCTCCATCGAGAAAACCATCAGCAAGGCCAAGGGCCAGCCCCGCGAGCCTCAAGTGTGTACCCTGCCCCCTAGCCA GGAAGAGATGACCAAGAACCAGGTGTCCCTGAGCTGTGCCGTGAAAGGCTTCTACCCCAGCGACATTGCCGTGGAA TGGGAGAGCAACGGCCAGCCCGAGAACAACTACAAGACCACCCCCCCTGTGCTGGACAGCGACGGCTCATTCTTCCT GGTGTCCAAGCTGACCGTGGACAAGAGCCGGTGGCAGGAAGGCAACGTGTTCAGCTGCTCCGTGATGCACGAGGCC CTGCACAACCACTACACCCAGAAGTCCCTGTCTCTGTCCCTGGGC |
| | 3 | 592 | CAGGTGCAGCTGGTGCAGTCTGGCGGCCAGATGAAGAAACCCGGCGAGAGCATGCGGATCAGCTGCAGAGCCAGCG GCTACGAGTTCATCGACTGCACCCTGAACTGGATCAGACTGGCCCCTGGCAAGCGGCCTGAGTGGATGGGATGGCTG AAGCCTAGATGGGGAGCCGTGAACTACGCCAGACCTCTGCAGGGCAGAGTGACCATGACCCGGCAGCTGAGCCAGG ACCCTGATGATCCGGATTGGGGCACCGCCTTCCTGGAACTGCGGAGCCTGACCGTGGATGATACCGCCGTGTACTTC TGCACCCGGGGCAAGAACTGCGACTACAACTGGGACTTCGAGCACTGGGGCAGAGGCACCCCTGTGATCGTGTCAA GCGCGTCGACCAAGGGCCCATCGGTGTTCCCTCTGGCCCCTTGCAGCAGAAGCACCAGCGAATCTACAGCCGCCNTG GGCTGCCTCGTGAAGGACTACTTTCCCGAGCCCGTGACCGTGTCCTGGAACTCTGGCGNTNTGACAAGCGGCGTGCA CACCTTTCCAGCCGTGCTCCAGAGCAGCGGCCTGTACTCTCTGAGCAGCGTCGTGACAGTGCCCAGCAGCAGCCTGG GCACCAAGACCTACACCTGTAACGTGGACCACAAGCCCAGCAACACCAAGGTGGACAAGCGGGTGGAATCTAAGTA CGGCCCTCCCTGCCCTCCTTGCCCAGCCCCTGAAGCTGCCGGCGGACCCTCCGTGTTCCTGTTCCCCCCAAAGCCCAA GGACACCCTGATGATCAGCCGGACCCCCGAAGTGACCTGCGTGGTGGTGGATGTGTCCCAGGAAGATCCCGAGGTG CAGTTCAATTGGTACGTGGACGGCGTGGAAGTGCACAACGCCAAGACCAAGCCCAGAGAGGAACAGTTCAACAGCA CCTACCGGGTGGTGTCCGTGCTGACCGTGCTGCACCAGGACTGGCTGAACGGCAAAGAGTACAAGTGCAAGGTGTCC AACAAGGGCCTGCCCAGCTCCATCGAGAAAACCATCAGCAAGGCCAAGGGCCAGCCCCGCGAGCCTCAAGTGTATA CCCTGCCCCCTTGCCAGGAAGAGATGACCAAGAACCAGGTGTCCCTGTGGTGTCTCGTGAAAGGCTTCTACCCCAGC GACATTGCCGTGGAATGGGAGAGCAACGGCCAGCCCGAGAACAACTACAAGACCACCCCCCCTGTGCTGGACAGCG ACGGCTCATTCTTCCTGTACTCCAAGCTGACCGTGGACAAGAGCCGGTGGCAGGAAGGCAACGTGTTCAGCTGCTCC GTGATGCACGAGGCCCTGCACAACCACTACACCCAGAAGTCCCTGTCTCTGTCCCTGGGC |
| | 4 | 593 | CTGACACAGAGCCCTGGCACCCTGTCACTGAGCCCAGGCGAGACAGCCATCATCAGCTGCCGGACAAGCCAGTACG GCAGCCTGGCCTGGTATCAGCAGAGGCCTGGACAGGCCCCCAGACTCGTGATCTACAGCGGCAGCACAAGAGCCGC CGGAATCCCCGATAGATTCAGCGGCTCCAGATGGGGACCCGACTACAACCTGACCATCAGCAACCTGGAAAGCGGC GACTTCGGCGTGTACTACTGCCAGCAGTACGAGTTCTTCGGCCAGGGCACCAAGGTGCAGGTGGACATCAAGCGTAC GGTGGCCGCTCCCAGCGTGTTCATCTTCCCACCTAGCGACGAGCAGCTGAAGTCCGGCACAGCCTCTGTCGTGTGCCT GCTGAACAACTTCTACCCCCGCGAGGCCAAAGTGCAGTGGAAGGTGGACAACGCCCTGCAGAGCGGCAACAGCCAG GAAAGCGTGACCGAGCAGGACAGCAAGGACTCCACCTACAGCCTGAGCAGCACCCTGACACTGAGCAAGGCCGACT ACGAGAAGCACAAGGTGTACGCCTGCGAAGTGACCCACCAGGGCCTGTCTAGCCCCGTGACCAAGAGCTTCAACCG GGGCGAGTGT |

EXAMPLES

The Examples that follow are illustrative of specific embodiments of the disclosure, and various uses thereof. They are set forth for explanatory purposes only, and should not be construed as limiting the scope of the invention in any way.

Example 1: Development of Trispecific HER2/CD28×CD3 Antibodies and Variant Anti-CD3 Binding Sites Immuno-oncology is a promising, emerging therapeutic approach to disease management in cancer. The immune system is the first line of defense against cancer development and progression. There is now large evidence that T cells are able to control tumor growth and prolong the survival of cancer patients in both early and late stages of disease. However, T cells specific for tumors can be limited in a number of ways preventing them from controlling the disease.

In order to remove the limitations on T cells induced by uncontrolled tumors, novel antibodies were developed in the trispecific antibody format depicted in FIG. 1A to specifically activate the T cells to engage HER2 expressing cancer cells. These novel trispecific antibodies are able to bind to three targets: HER2, CD3, and CD28. Anti-HER2 and anti-CD3 binding sites were further optimized for high affinity binding and reduction in potential manufacturing liabilities.

HER2 amplification and overexpression can be found in molecular subtypes of breast cancer, and also in gastric, ovarian, lung and prostate carcinomas. Optimal activation of T cells requires two factors: (1) Antigen recognition and (2) Co-stimulation. Using the trispecific HER2/CD28×CD3 trispecific binding proteins described herein, Signal 1 is provided by an agonist anti-CD3 binding site, and Signal 2 is provided by an agonist anti-CD28 binding site (see, e.g., FIG. 1D). It is thought that the trispecific antibodies described in the subsequent Examples recruit T cells to the tumor via HER2 and activate the engaged T cells by binding to CD3 and CD28. The resulting activation induces the killing potential of the immune cells against the nearby tumor cells.

Materials and Methods

Production and Characterization of Antibodies

Trispecific antibody variants were produced by transient transfection of expression plasmids into Expi293 cells. 5 days after transfection, the supernatant from transfected cells was collected, quantified and normalized by absorbance at 280 nm on Nano Drop. The binding of supernatant to corresponding antigens were determined by ELISA and the absorbance of parental HER2 WT tri Ab was set as 1.0. The fold changes of other variants were calculated by dividing the corresponding absorbance to that of parental Ab.

Trispecific antibody variants were purified using protein A affinity purification followed by SEC purification. The binding of purified antibodies to corresponding antigens were determined by ELISA. The EC50 were determined based on the binding curve generated by Graphpad Prism7.

Results

Figure 1B:
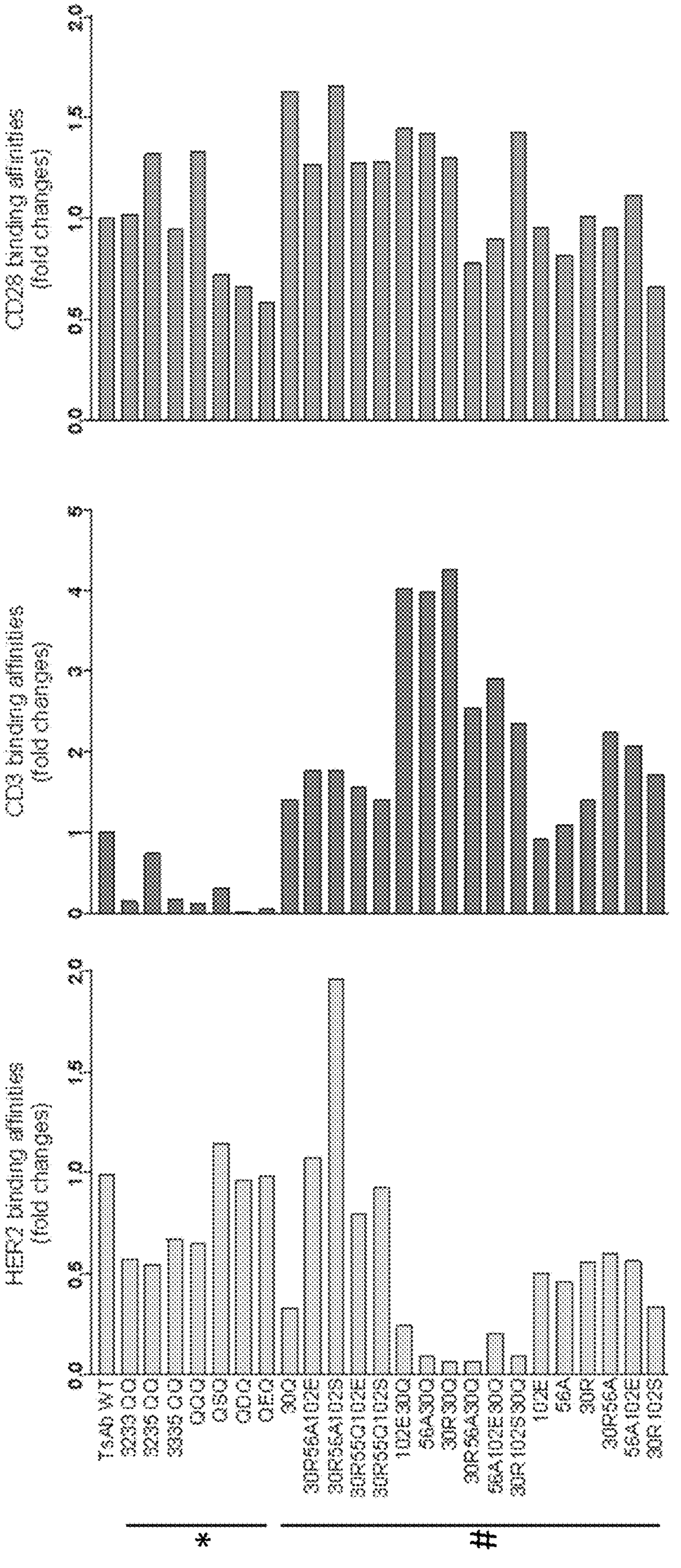
FIG. 1B provides the fold change (vs. parental) in binding affinities of anti-CD28/CD3/HER2 trispecific antibody variants using the indicated anti-HER2, anti-CD3, and anti-CD28 binding domains. Mutations 3233QQ to QEQ (top to bottom) refer to mutations introduced into residues 32-35 of the VL domain of the anti-CD3 binding site (indicated by *); the remaining mutations were introduced into the VH or VL domain of the trastuzumab anti-HER2 binding site (indicated by #; numbering according to Kabat). For the mutations in the anti-HER2 binding site, mutation 30Q was introduced into the VL domain, and the remaining mutations were introduced into the VH domain. The binding affinities were measured by ELISA, and the values provided are relative to parental trispecific antibody.

Trispecific Ab variants were produced with several mutations in the binding arms in order to mitigate potential manufacturing liabilities, e.g., deamidation sites. A binding ELISA assay was performed to assess binding of the indicated trispecific antibodies to each of the three targets: HER2, CD3, and CD28. In FIG. 1B, HER2/CD3×CD28 trispecific antibodies with the indicated anti-HER2 or anti-CD3 variants were compared to parental Trispecific Ab. Introducing some sets of mutations (e.g., 32/33 QQ and 33/35QQ) into the VL domain of the anti-CD3 binding site led to dramatically reduced binding to CD3, whereas 32/35 QQ mutations retained near wild-type binding. MS peptide analyses showed that binding sites with the DNAQ mutations in CDR-L1 (SEQ ID NO:63) were still subject to greater than 15% deamidation, whereas ENLQ (SEQ ID NO:281), ENLF (SEQ ID NO:282), and ENLR (SEQ ID NO:283) led to less than 5% deamidation. Importantly, these variants also retained binding to CD3.

Figure 1C:
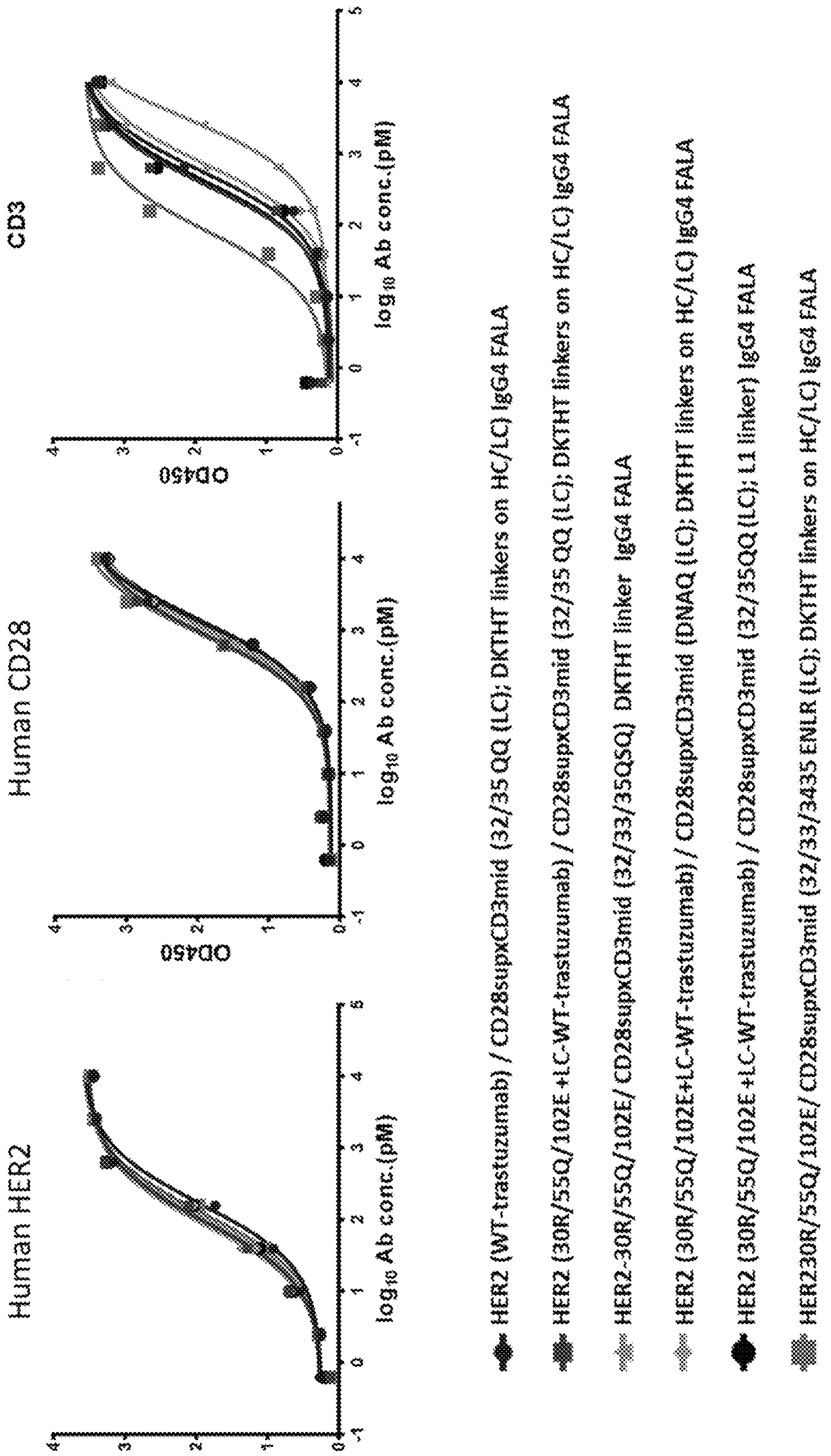
FIG. 1C provides binding curves for the indicated trispecific antibodies binding to human HER2, human CD28, and CD3, as determined by ELISA.

In addition, binding curves for the indicated antibodies binding to human HER2, human CD28, and CD3 are provided in FIG. 1C. The EC50 values of selected trispecific antibody variants are provided in Table E.

TABLE E

A binding ELISA assay was performed on purified trispecific antibodies to determine their binding affinities for HER2, human CD3, and human CD28.

| | Binding Affinity (ELISA)(nM) EC50 | | |
|---|---|---|---|
| Trispecific antibody | HER2 | Human CD3 | Human CD28 |
| HER2 (WT-trastuzumab)/ CD28supxCD3mid (32/35 QQ (LC); DKTHT linkers on HC/LC) IgG4 FALA | 162.3 | 566.4 | 1321 |
| HER2 (30R/55Q/102E + LC-WT-trastuzumab)/ CD28supxCD3mid (32/35 QQ (LC); DKTHT linkers on HC/LC) IgG4 FALA | 93.66 | 364.8 | 871.9 |
| HER2-30R/55Q/102E/ CD28supxCD3mid (32/33/35QSQ) DKTHT linker IgG4 FALA | 83.89 | 3222 | 1024 |
| HER2 (30R/55Q/102E + LC-WT-trastuzumab)/ CD28supxCD3mid (DNAQ (LC); DKTHT linkers on HC/LC) IgG4 FALA | 111.2 | 725.7 | 1053 |
| HER2 (30R/55Q/102E + LC-WT-trastuzumab)/ CD28supxCD3mid (32/35QQ (LC); L1 linker) IgG4 FALA | 111.5 | 412.5 | 1345 |
| HER230R/55Q/102E/ CD28supxCD3mid (32/33/3435 ENLR (LC); DKTHT linkers on HC/LC) IgG4 FALA | 123.9 | 81.53 | 878.8 |
| HER2 (30R/56A/102S + LC-WT-trastuzumab)/ CD28supxCD3mid (32/35QQ185E) IgG4 FALA | 516.0 | 5494 | 3631 |
| HER2-30R/55Q/102E + LC-30Q/CD28supxCD3mid (32/35QQ) 185S L1 linker IgG4 FALA | 1540 | 10616 | 2036 |
| HER2-30R/55Q/102E/ CD28supxCD3mid (32/33/35QSQ) 185S L1 linker IgG4 FALA | 467.0 | 19382 | 1814 |
| HER2-30R/55Q/102E/ CD28supxCD3mid (32/33/35QSQ) 185E L1 linker IgG4 FALA | 478.6 | 19756 | 1739 |

TABLE E-continued

A binding ELISA assay was performed on purified trispecific antibodies to determine their binding affinities for HER2, human CD3, and human CD28.

| Trispecific antibody | Binding Affinity (ELISA)(nM) EC50 HER2 | Human CD3 | Human CD28 |
|---|---|---|---|
| HER2/CD28supxCD3mid DKTHT linkers on HC/LC) IgG4 FALA | 228.9 | 671.2 | 752 |
| HER2/CD28supxCD3mid (32/33/3435 ENLF (LC); DKTHT linkers on HC/LC) IgG4 FALA | 195.9 | 773.3 | 1466 |
| HER2/CD28supxCD3mid (32/33/3435 ENLQ (LC); DKTHT linkers on HC/LC) IgG4 FALA | 212.1 | 10558 | 2405 |
| HER2/CD28supxCD3mid (32/33/3435 ENLR (LC); DKTHT linkers on HC/LC) IgG4 FALA | 166.2 | 381.9 | 1051 |
| anti-Her2/CD3/3CD28 IgG4 FALA | 176.1 | 516.2 | 870.6 |

Figure 1D:
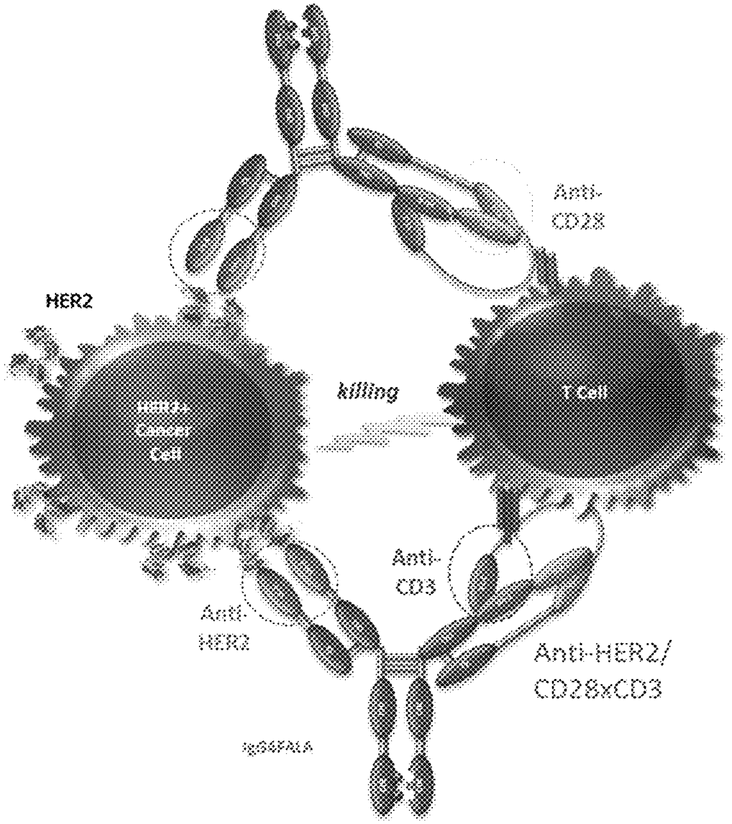
FIG. 1D provides a proposed mechanism of action for HER2/CD28×CD3 trispecific antibody-mediated T cell activation and HER2+ cancer cell killing.

Without wishing to be bound by theory, as depicted in FIG. 1D, it is believed that HER2/CD3/CD28 trispecific antibodies recruit T cells to cancer cells through the anti-HER2 and anti-CD3/CD28 arms. Further, it is believed that engaged T cells are activated by the anti-CD28/CD3 arms. Killing of cancer cells is believed, without wishing to be bound by theory, to occur through T cell mediated mechanisms (e.g., Perform, granzyme). Without wishing to be bound to theory, it is contemplated that similar mechanisms may allow for killing of other types of tumors by substituting antigen binding sites that recognize other tumor target proteins.

Example 2: Development of Trispecific CD38/CD3×CD28 Antibodies

Trispecific CD38/CD3×CD28 antibodies were developed and characterized for binding to CD38, CD3 and CD28 polypeptides.

Materials and Methods

Generation of CD381CD28×CD3 Trispecific Antibodies

Figure 2A:
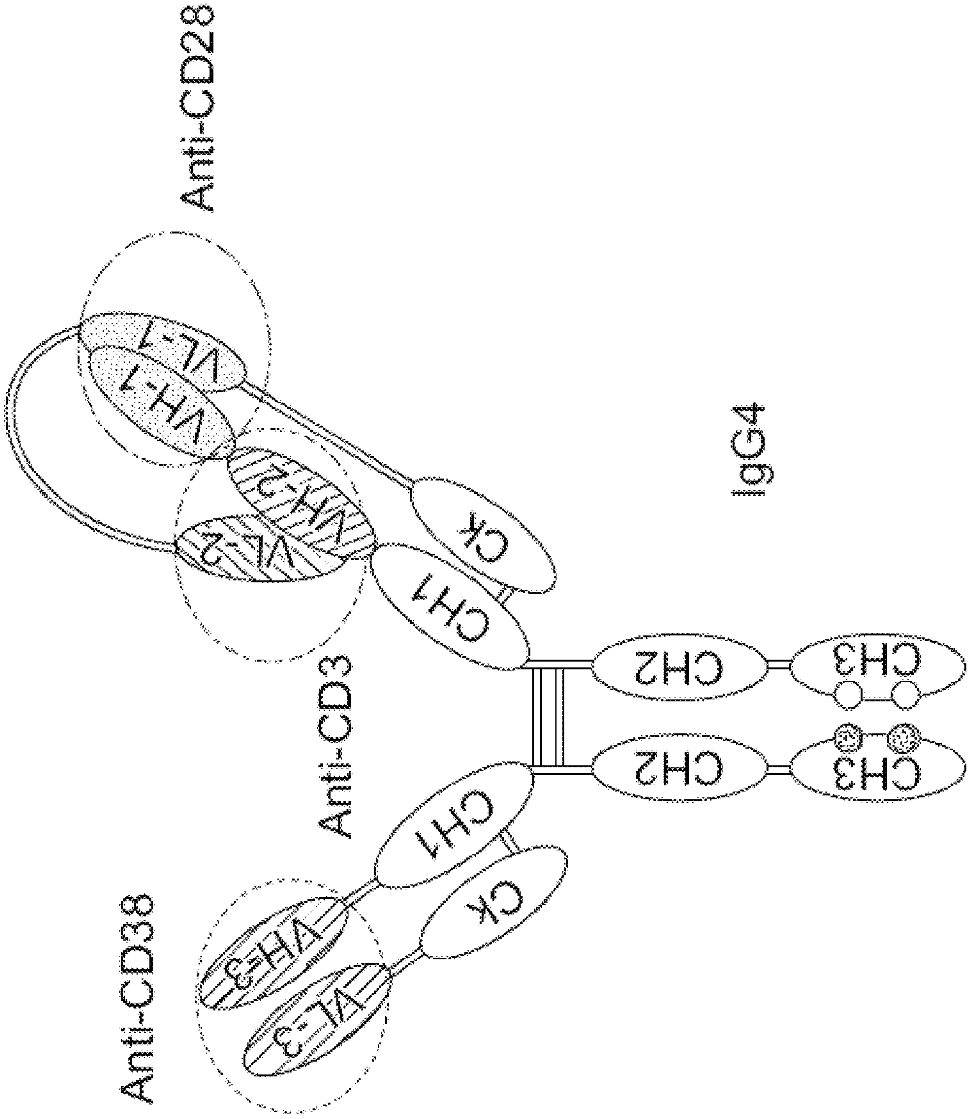
FIG. 2A provides a schematic representation of a trispecific binding protein comprising four polypeptide chains that form three antigen binding sites that binds three target proteins: CD28, CD3, and CD38. A first pair of polypeptides possess dual variable domains having a cross-over orientation (VH1-VH2 and VL2-VL1) forming two antigen binding sites that recognize CD3 and CD28, and a second pair of polypeptides possess a single variable domain (VH3 and VL3) forming a single antigen binding site that recognizes CD38. The trispecific binding protein shown in FIG. 2A uses an IgG4 constant region with a "knobs-into-holes" mutation, where the knob is on the second pair of polypeptides with a single variable domain.
Figure 2B:
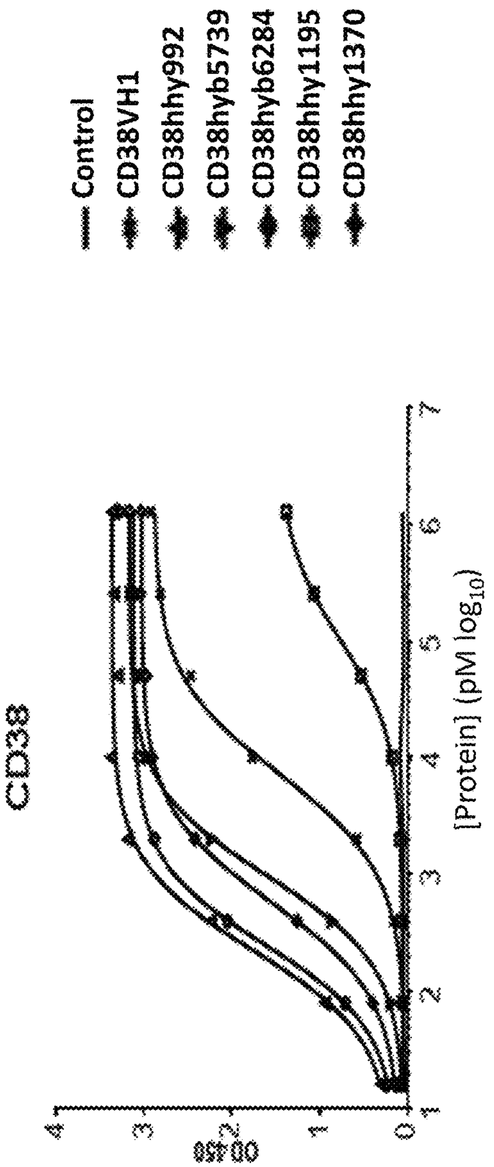
FIGS. 2B-2E show the binding affinities, as measured by ELISA, of CD38/CD28sup×CD3mid_ENLQ DKTHT IgG4 FALA trispecific antibodies with the indicated anti-CD38 binding domains for the target antigens human CD38 (FIG. 2B), cynomolgus monkey CD38 (FIG. 2C), human CD3 (FIG. 2D), and human CD28 (FIG. 2E).
Figure 2C:
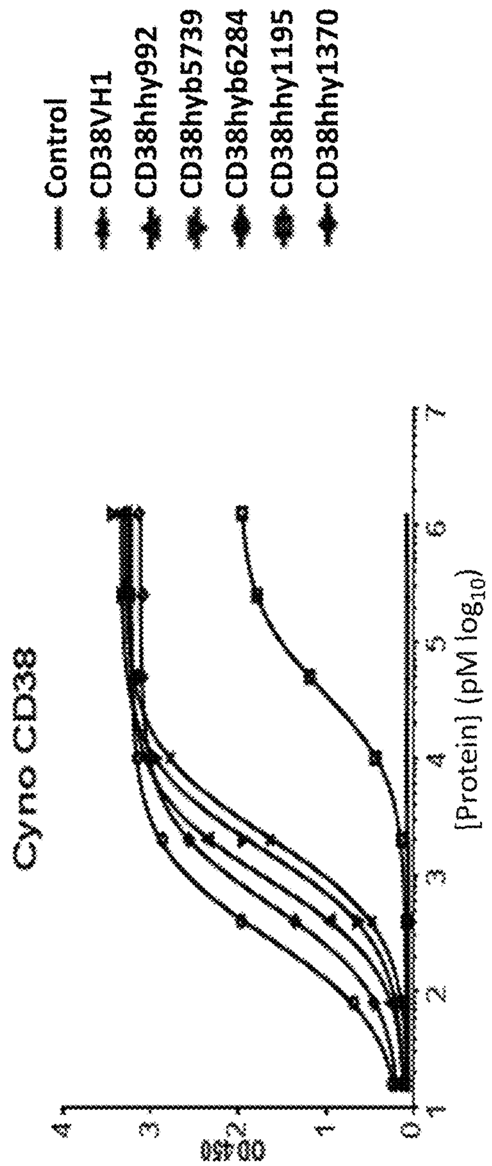
Figure 2D:
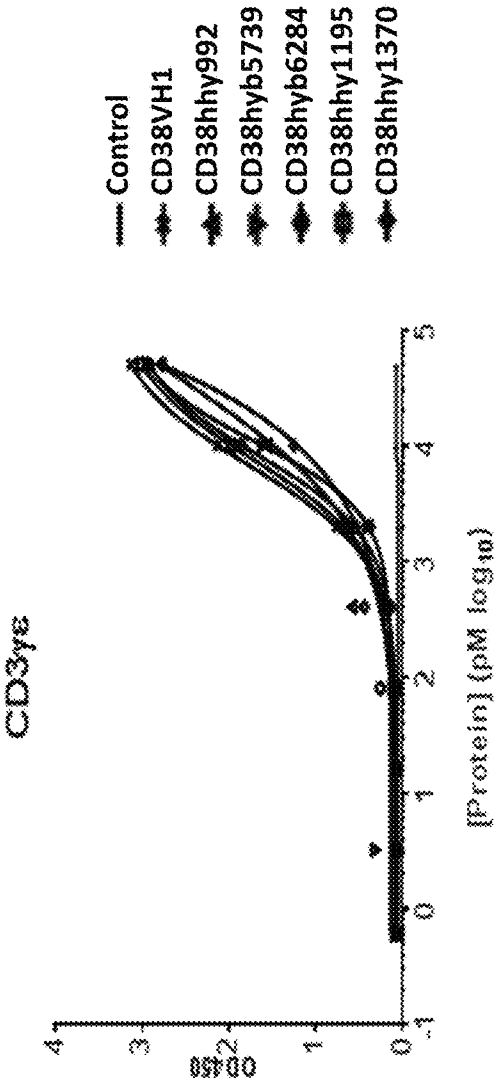

A panel of anti-CD38, anti-CD3, and anti-CD28 antibodies, as well as human IgG4 Fc domains were used to generate CD38/CD28×CD3 trispecific antibodies in the trispecific antibody format depicted in FIG. 2A.

Trispecific binding proteins were produced by transient transfection of 4 expression plasmids into Expi293 cells using ExpiFectamine™ 293 Transfection Kit (Thermo Fisher Scientific) according to manufacturer's protocol. Briefly, 25% (w/w) of each plasmid was diluted into Opti-MEM, mixed with pre-diluted ExpiFectamine reagent for 20-30 minutes at room temperature (RT), and added into Expi293 cells ($2.5\times10^6$ cells/ml). An optimization of transfection to determine the best ratio of plasmids was often used in order to produce the trispecific binding protein with good yield and purity.

4-5 days post transfection, the supernatant from transfected cells was collected and filtered through 0.45 μm filter unit (Nalgene). The trispecific binding protein in the supernatant was purified using a 3-step procedure. First, protein A affinity purification was used, and the bound Ab was eluted using "IgG Elution Buffer" (Thermo Fisher Scientific).

Second, product was dialyzed against PBS (pH7.4) overnight with 2 changes of PBS buffer. Any precipitate was cleared by filtration through 0.45 μm filter unit (Nalgene) before next step. Third, size-exclusion chromatography (SEC) purification (Hiload 16/600 Superdex 200 pg, or Hiload 26/600 Superdex 200 pg, GE Healthcare) was used to remove aggregates and different species in the prep. The fractions were analyzed on reduced and non-reduced SDS-PAGE to identify the fractions that contained the monomeric trispecific binding protein before combining them. The purified antibody can be aliquoted and stored at −80° C. long term.

ELISA Binding Assay

Binding affinities to each target antigen by the CD38/CD28×CD3 T cell engagers were measured by ELISA. Briefly, each antigen was used to coat the 96-well Immuno Plate (Thermo Fisher Scientific) overnight at 4° C. using 200 ng/well in PBS (pH7.4) of each antigen. The coated plate was blocked using 5% skim milk+2% BSA in PBS for one hour at RT, followed by washing with PBS+0.25% Tween 20 three times (Aqua Max 400, Molecular Devices). Serial dilution of antibodies (trispecific and control Abs) were prepared and added onto the ELISA plates (100 μl/well in duplicate), incubated at room temperature (RT) for one hour, followed by washing 5 times with PBS+0.25% Tween 20. After washing, the HRP conjugated secondary anti-human Fab (1:5000, Cat. No. 109-035-097, Jackson ImmunoResearch Inc) was added to each well and incubated at RT for 30 minutes. After washing 5 times with PBS+0.25% Tween 20, 100 μl of TMB Microwell Peroxidase Substrate (KPL, Gaithersburg, Md., USA) was added to each well. The reaction was terminated by adding 50 μl 1M $H_2SO_4$, and OD450 was measured using SpectraMax M5 (Molecular Devices) and analyzed using SoftMax Pro6.3 software (Molecular Devices). The final data was transferred to GraphPad Prism software (GraphPad Software, CA, USA), and plotted. EC50 was calculated using the same software.

Measurement of Trispecific Antibody Binding Using SPR

Human CD38-His antigens were used (Cambridge Biologics, Cambridge, Mass.) for full kinetic analysis. Kinetic characterization of purified antibodies was performed using SPR technology on a BIACORE 3000 (GE Healthcare). A capture assay using human IgG1 specific antibody capture and orientation of the investigated antibodies was used. For capture of Fc containing protein constructs the human antibody capture kit (GE Healthcare) was used. For capture of His tagged antigen, anti-His antibody capture kit (GE Healthcare) was used. The capture antibody was immobilized via primary amine groups (11000 RU) on a research grade CM5 chip (GE Life Sciences) using standard procedures. The analyzed antibody was captured at a flow rate of 10 μL/min with an adjusted RU value that would result in maximal analyte binding signal of typically 30 RU. Binding kinetics were measured against the trispecific antibodies. Assay buffer HBS EP (10 mM HEPES, pH 7.4, 150 mM NaCl, 3 mM EDTA, and 0.005% Surfactant P20) was used at a flow rate of 30 μl/min. Chip surfaces were regenerated with the regeneration solution of the respective capture kit. Kinetic parameters were analyzed and calculated in the BIA evaluation program package v4.1 using a flow cell without captured antibody as reference and the 1:1 Langmuir binding model with mass transfer.

Daratumumab Competition Binding Assay

For Daratumumab competition binding assay, Daratumumab was amine coupled to the active surface of CM5 chip. Reference surface was left blank and used to subtract any non-specific binding of injected molecules. Recombinant CD38-His (Sino Biological, Part #10818-H08H) was injected over the Daratumumab surface followed by injection of test antibodies. If a monospecific anti-CD38 antibody recognized an epitope on CD38 which was different from that of Daratumumab, injection of the antibody resulted in an increased SPR signal. If an antibody recognized an overlapping epitope as Daratumumab, injection of the antibody did not increase SPR signal.

Results

The binding affinities of selected CD38/CD28sup×CD3mid_ENLQ DKTHT IgG4 FALA trispecific antibodies with alternative anti-CD38 binding domains for human CD38 were determined by SPR. The association rate constant ($K_{On}$), dissociation rate constant ($K_{Off}$), and the $K_D$ of the selected trispecific antibodies are provided in Table A. The selected trispecific antibodies showed various degrees of affinities against human CD38 antigen.

TABLE A

Binding characteristics of selected CD38/CD28sup x CD3mid_ENLQ DKTHT IgG4 FALA trispecific antibodies with alternative anti-CD38 binding domains for human CD38 determined by SPR.

| Anti-CD38 binding domain | $k_{on}$ (M⁻¹s⁻¹) | $k_{off}$ (s⁻¹) | $K_D$ (M) |
|---|---|---|---|
| CD38VH1    | 5.55E+05 | 1.58E−03 | 2.85E−09 |
| CD38hhy992 | 1.35E+06 | 1.75E−04 | 1.29E−10 |
| CD38hyb6284| 7.85E+05 | 5.12E−04 | 6.52E−10 |
| CD38hyb5739| 9.80E+05 | 5.46E−03 | 5.57E−09 |
| CD38hhy1195| 1.27E+06 | 1.80E−02 | 1.42E−08 |
| CD38hhy1370| 3.76E+05 | 3.29E−04 | 8.76E−10 |

Figure 2E:
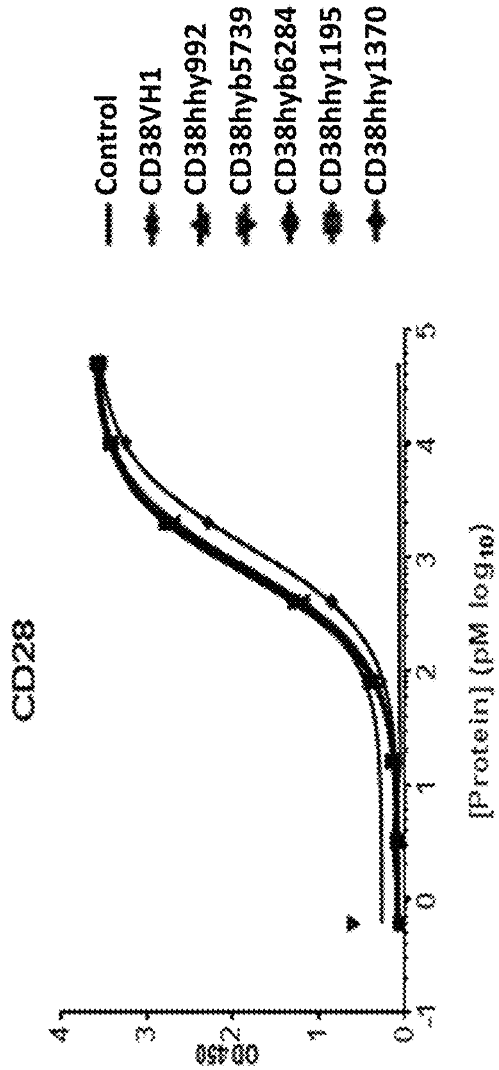

The binding affinities of selected CD38/CD28sup×CD3mid_ENLQ DKTHT IgG4 FALA trispecific antibodies with alternative anti-CD38 binding domains for human CD3, human CD28, human CD38 and cynomolgus monkey CD38 were then determined by ELISA as described above. As shown in FIGS. 2B-2E, the selected CD38/CD28sup×CD3mid_ENLQ DKTHT IgG4 FALA trispecific antibodies with alternative anti-CD38 binding domains showed various affinities to human (FIG. 2B) and cynomolgus monkey CD38 (FIG. 2C), but similar affinity to human CD3 (FIG. 2D) and CD28 (FIG. 2E). EC50 values were then calculated by GraphPad Prism 7.02 using variable slope model with four-parameter logistic curve. The EC50 values of the selected trispecific antibodies for human CD3, human CD28, human CD38 and cynomolgus monkey CD38 are provided in Table B. Control antibody was a human IgG4 isotype control.

TABLE B

EC50 values of selected CD38/CD28sup x CD3mid_ENLQ DKTHT IgG4 FALA trispecific antibodies with alternative anti-CD38 binding domains for human CD3, human CD28, human CD38 and cynomolgus monkey CD38.

| Anti-CD38 binding domain | EC50 (pM) | | | |
|---|---|---|---|---|
| | hCD38 | Cyno CD38 | hCD3 | hCD28 |
| CD38VH1     | 7244   | 2128  | 6742  | 725  |
| CD38hhy992  | 229    | 912   | 33593 | 809  |
| CD38hyb6284 | 253    | 290   | 8222  | 711  |
| CD38hyb5739 | 984    | 1628  | 10791 | 825  |
| CD38hhy1195 | 102537 | 37701 | 7631  | 697  |
| CD38hhy1370 | 587    | 553   | 24968 | 1257 |

Figure 3:
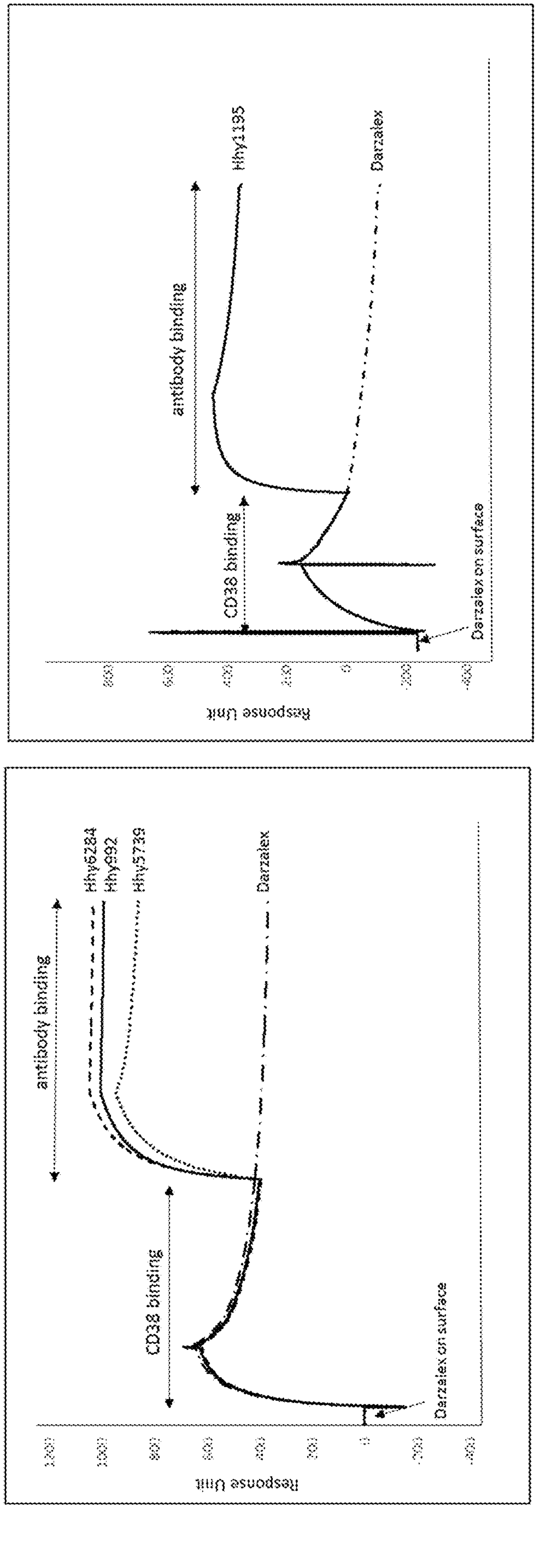
FIG. 3 shows SPR competition assays for binding to CD38 by Daratumumab and anti-CD38 monospecific antibodies with the indicated anti-CD38 binding domains. If an antibody recognized an epitope on CD38 which was different from that of Daratumumab, injection of the antibody resulted in an increased SPR signal. If an antibody recognized an overlapping epitope as Daratumumab, injection of the antibody did not increase SPR signal.

An SPR competition assay was carried out to determine whether anti-CD38 antibodies hhy6284, hhy992, hhy5379, or hhy1195 (tested in monospecific antibody format) compete with Daratumumab for binding to CD38. Following CD38 injection over Daratumumab (immobilized on SPR sensor chip), the test antibodies (or Daratumumab) were injected over the Daratumumab/CD38 complex. As shown in FIG. 3, injection of Hyb6264, hhy992, Hyb5379, and Hhy1195 increased SPR signal, indicating that these antibodies recognized the epitopes on CD38 which are different from the epitope which Daratumumab recognizes. As expected, injection of free Daratumumab (a competitive binding control) did not increase the SPR signal.

Binding of anti-CD38 antibodies to human or cynomolgus CD38 polypeptides is summarized in Table B2.

TABLE B2

Summary of anti-CD38 binding characteristics to human or cynomolgus CD38.

| Name | ELISA huCD38 EC50 nM | ELISA cynoCD38 EC50 nM | FACS huCD38 EC50 nM | FACS cynoCD38 EC50 nM | SPR huCD38 KD M | SPR cynoCD38 KD M |
|---|---|---|---|---|---|---|
| AntiCD38_hyb_5739 | 0.12 | 0.09 | 0.3 | 0.5 | | |
| AntiCD38_hyb_6284 | 0.11 | 0.13 | 0.4 | 0.7 | | |
| AntiCD38_hhy_992  | 0.09 | 0.08 | 100  | 288  | 3.65E−10 | 6.12E−09 |
| AntiCD38_hhy_1195 | 1.4  | 0.86 | 38   | 15   | 4.00E−08 | 2.60E−08 |

Anti-CD38 antibodies were also tested for competitive binding to daratumumab in SPR assay. For daratumumab competition binding assay, daratumumab was amine coupled to the active surface of CM5 chip. Reference surface was left blank and used to subtract any non-specific binding of injected molecules. Recombinant CD38-His (Sino Biological, Part #10818-H08H) was injected over the daratumumab surface followed by injection of test antibodies. If an antibody recognizes an epitope on CD38 which is different from that of daratumumab, injection of the antibody will result in an increased SPR signal. If an antibody recognizes an overlapping epitope as daratumumab, injection of the antibody will not increase SPR signal. According to the results of these assays the tested antibodies hhy992, hyb6284, hhy1195 and hhy1370 did not compete with daratumumab.

Example 3: Trispecific CD38/CD3×CD28 Antibodies Promote Lysis of Human Multiple Myeloma and Lymphoma Tumor Cells An in vitro cell lysis assay was used to determine whether trispecific CD38/CD3×CD28 antibodies had anti-tumor cell activity using human multiple myeloma and lymphoma cells.

Materials and Methods

In Vitro Killing Assay Against Tumor Cells Using Human T Cells

Target tumor cells were labeled with the membrane dye PKH-26 (Sigma) and co-cultured for 24 hours with human PBMC or enriched CD8 T cells as effector cells at E:T ratio of 10:1 (E:T=3:1 using enriched CD8 T cells) in the presence of indicated concentrations of tri-specific or relevant control antibodies. Peripheral blood mononuclear cells were isolated from normal human donors by Ficoll separation, and autologous CD8+ or pan-T cells were enriched using kits from Miltenyi Biotech (San Diego, Calif.). The extent of cell lysis in the target cells was determined by staining with a LIVE/DEAD™ Fixable Violet Dead Cell Stain Kit (Life Technologies) and measured by the number of dead cells in the labelled target cell population by running the samples on an LSRFortessa instrument (BD Biosciences) followed by analysis using the Flowjo software (Treestar).

In Vitro Killing Assay Against Tumor Cells Using Human T Cells in the Presence of Daratumumab 5 nM Daratumumab or isotype control antibodies were pre-incubated with PKH-26 labeled target tumor cells ($10^5$ cells/well) for 30 minutes, followed by addition of trispecific TCEs at indicated concentrations, and human PBMCs (E:T=10:1). 24 hours later, the extent of cell lysis in the target cells was determined by staining with a LIVE/DEAD™ Fixable Violet Dead Cell Stain Kit (Life Technologies) and measured by the number of dead cells in the labelled target cell population by running the samples on an LSRFortessa instrument (BD Biosciences) followed by analysis using the Flowjo software (Treestar).

Results

Figure 4A:
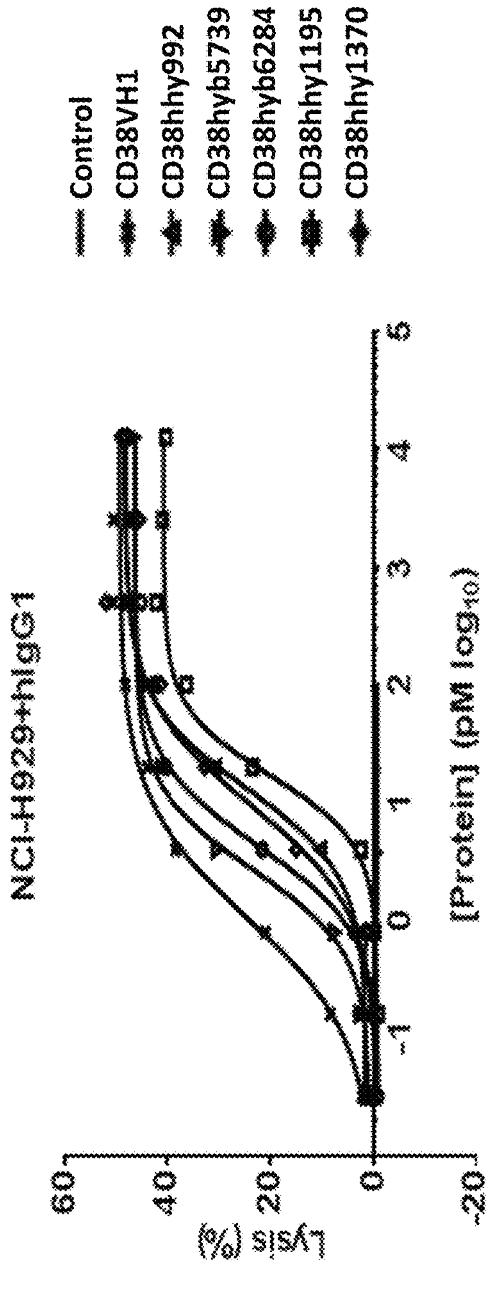
FIGS. 4A-4B show the in vitro cell killing activity of CD38/CD28sup×CD3mid_ENLQ DKTHT IgG4 FALA trispecific antibodies with the indicated anti-CD38 binding domains against human multiple myeloma NCI-H929 cells (CD38+/CD28+). The assays were carried out in the presence of 5 nM isotype control antibody (FIG. 4A) or Daratumumab (FIG. 4B). In the presence of daratumumab, the trispecific antibodies continued to exhibit cell killing activity.
Figure 4B:
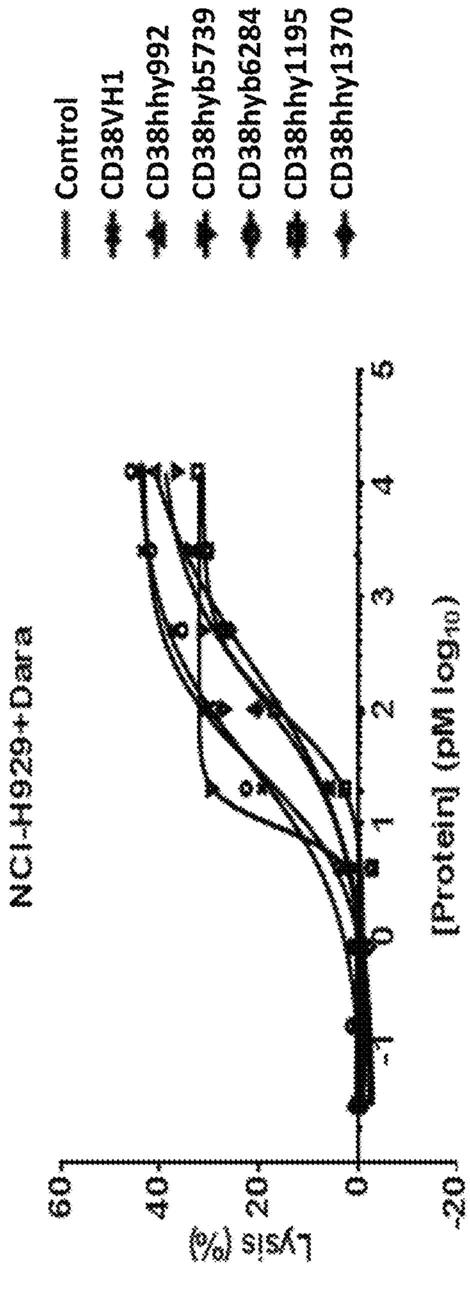

The in vitro cell killing activity of CD38/CD28sup×CD3mid_ENLQ DKTHT IgG4 FALA trispecific antibodies with alternative anti-CD38 binding domains was determined using a human multiple myeloma cell line NCI-H929 that expresses both CD38 and CD28. The assay was carried out in the presence of 5 nM Daratumumab or isotype control antibodies (present during the assay period). As shown in FIGS. 4A-4B, all tested trispecific antibodies led to cell lysis in a concentration-dependent manner in the presence and absence of Daratumumab. The EC50 values were then calculated in the presence and absence of Daratumumab (Table C). The cell killing activities of trispecific antibodies CD38/CD28sup×CD3mid_ENLQ DKTHT IgG4 FALA with the CD38VH1 or CD38hhy1370 anti-CD38 binding domains were reduced by Daratumumab, while trispecific antibodies with the CD38hyb5739, CD38hyb6284, or CD38hhy1195 anti-CD38 binding domains exhibited between 3-8 fold reductions in cell killing activity in the presence of Daratumumab (Table C).

TABLE C

In vitro killing activity against human multiple myeloma cell line NCI-H929 (CD38+/CD28+) by CD38/CD28sup x CD3mid_ENLQ DKTHT IgG4 FALA trispecific antibodies with alternative anti-CD38 binding domains in the presence of Daratumumab.

| EC50 | Anti-CD38 binding domains | | | | | |
|---|---|---|---|---|---|---|
| (pM) | CD38VH1 | CD38hhy992 | CD38hyb5739 | CD38hyb6284 | CD38hhy1195 | CD38hhy1370 |
| With Dara | 29.82 | 125.8 | 9.115 | 33.65 | 89.27 | 255.4 |
| With human IgG1 | 1.063 | 13.43 | 2.736 | 4.37 | 16.97 | 9.599 |

Figure 5A:
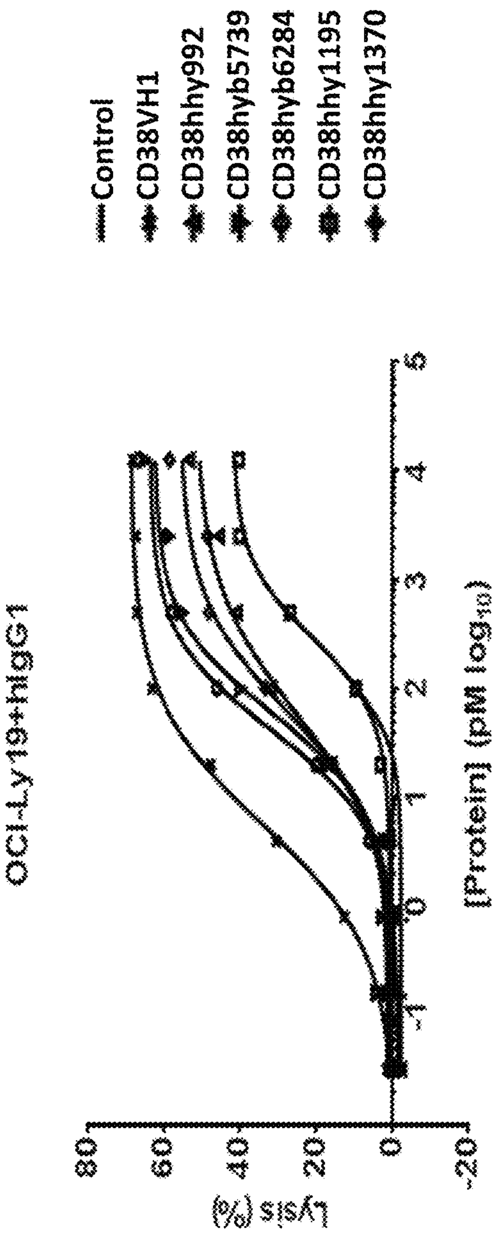
FIGS. 5A-5B show the in vitro cell killing activity of CD38/CD28sup×CD3mid_ENLQ DKTHT IgG4 FALA trispecific antibodies with the indicated anti-CD38 binding domains against human lymphoma OCI-Ly19 cells (CD38+/CD28-). The assays were carried out in the presence of 5 nM isotype control antibody (FIG. 5A) or Daratumumab (FIG. 5B). Daratumumab caused a decrease in the cell killing activity of anti-CD38/CD28×CD3 trispecific antibodies.
Figure 5B:
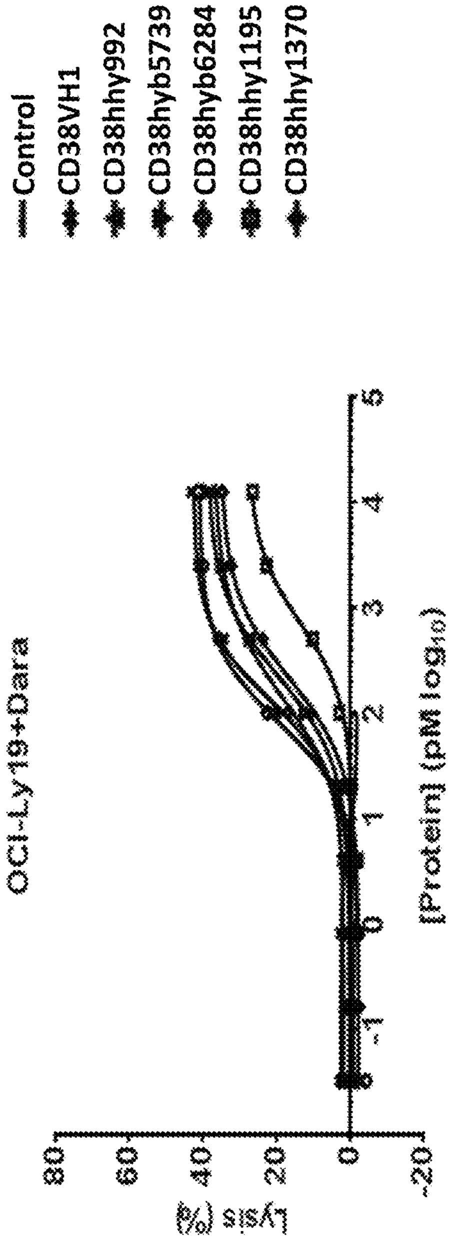

In addition, an in vitro cell lysis assay was used to measure the cell killing activity of selected CD38/CD28sup×CD3mid_ENLQ DKTHT IgG4 FALA trispecific antibodies with alternative anti-CD38 binding domains using a human lymphoma cell line OCI-LY19 that expresses CD38 but not CD28. The assay was carried out in the presence of 5 nM Daratumumab or isotype control antibodies which were present in the assay period. As shown in FIGS. 5A-5B, all tested trispecific led to cell lysis in a concentration-dependent manner in the presence and absence of Daratumumab. The EC50 values were then calculated in the presence and absence of Daratumumab (Table D). The cell killing activity of CD38/CD28sup×CD3mid_ENLQ DKTHT IgG4 FALA trispecific antibodies with CD38VH1 anti-CD38 binding domain was reduced by about 24 fold by Daratumumab, while trispecific antibodies with the CD38hhy992, CD38hyb5739, CD38hyb6284, CD38hhy1195, or CD38hhy1370 anti-CD38 binding domains also exhibited reductions in cell killing activity in the presence of Daratumumab (Table D).

TABLE D

In vitro killing activity against human lymphoma cell line OCI-LY19 (CD38+/CD28−) by selected CD38/CD28sup x CD3mid_ENLQ DKTHT IgG4 FALA trispecific antibodies with alternative anti-CD38 binding domains in the presence of Daratumumab.

| EC50 | Anti-CD38 binding domains | | | | | |
|---|---|---|---|---|---|---|
| (pM) | CD38VH1 | CD38hhy992 | CD38hyb5739 | CD38hyb6284 | CD38hhy1195 | CD38hhy1370 |
| With Dara | 135.9 | 133.3 | 219.1 | 81.05 | 715.2 | 209.8 |

TABLE D-continued

In vitro killing activity against human lymphoma cell line OCI-LY19 (CD38+/CD28−) by selected CD38/CD28sup x CD3mid_ENLQ DKTHT IgG4 FALA trispecific antibodies with alternative anti-CD38 binding domains in the presence of Daratumumab.

| EC50 | Anti-CD38 binding domains | | | | | |
|---|---|---|---|---|---|---|
| (pM) | CD38VH1 | CD38hhy992 | CD38hyb5739 | CD38hyb6284 | CD38hhy1195 | CD38hhy1370 |
| With human IgG1 | 5.662 | 57.32 | 60.97 | 42.07 | 296.4 | 58.54 |

Example 4: CD38/CD28×CD3 Trispecific Antibodies Promote CMV-Specific Immune Response As part of adaptive immunity, T cell immunity plays a crucial role in controlling viral infection and cancer, possibly eliminating infected cells and malignant cells which result in clearance of viral infection or cure of cancer. In chronic infectious diseases such as Herpes viral infection (HSV, CMV, EBV, etc.), HIV, and HBV viruses establish their persistence in humans by various mechanisms including immune suppression, T cell exhaustion, and latency establishment. Nevertheless, viral infection generally induces viral antigen specific immunity including antigen specific CD8 T cells that can readily recognize infected cells for controlling or killing through cytokine release or cytotoxic T cell (CTL) mediated killing processes. Thus, viral antigen specific T cell activation and/or amplification in vivo and/or ex vivo provide therapeutic strategies against chronic viral infections.

Anti-CD38/CD28×CD3 trispecific antibodies were developed and evaluated for their potential in activating T cells, and promoting proliferation and/or amplification of antigen specific T cells. These trispecific Abs can effectively expand CD4 and CD8 effector and memory populations, including antigen specific CD8 T central memory and effector memory cells in vitro. Specifically, in vitro expansion of CMV and EBV specific CD8 central memory and effector memory cells were demonstrated. The anti-CD38/CD28×CD3 trispecific antibodies described herein exhibited novel properties by engaging CD3/CD28/CD38, providing signaling pathways to stimulate and expand T cells, which may offer an effective strategy treating chronic infectious diseases such as HSV, CMV, EBV, HIV-1, and HBV infections.

In this Example, the ability of CD38/CD28×CD3 trispecific antibodies to promote activation and expansion of CMV-specific T cells was determined.

Materials and Methods

In Vitro T Cell Proliferation Measurement

T cells were isolated from human PBMC donors by negative selection using a magnetic Pan T Cell Isolation Kit (Miltenyi Biotec GmbH, Germany). Antibodies were coated onto 96-well cell culture plates by preparing the antibodies in sterile PBS and dispensing 50 μL into each well (350 ng/well). The plates were then incubated at 37° C. for at least 2 hours and then washed with sterile PBS. The untouched T cells were added to the antibody-coated plates ($5\times10^5$ cells/mL) and incubated at 37° C. for multiple days. The cells were passaged with new cell culture media onto fresh antibody-coated plates on Day 4. In certain experiments with 7 days incubation, only fresh medium was added without changing to fresh antibody-coated plate. The cells were collected at specific time points and cell numbers calculated using CountBright™ counting beads.

In Vitro T Cell Proliferation Assay and T Cell Subset Determination

Peripheral blood mononuclear cells were isolated from blood of healthy human donors collected by Research Blood Components, LLC (Boston, Mass.). The PBMCs were added to antibody-coated plates (350 ng/well) ($5\times10^5$ cells/mL), as previously described above, and incubated at 37° C. for 3 and 7 days. The cells were collected at specific time points and analyzed by flow cytometry for T cell subsets: naïve (CCR7+ CD45RO−), Tcm (CCR7+ CD45RO+), Tem (CCR7− CD45RO+), Tregs (CD4+ Foxp3+ CD25hi). CMV pp65-specific and EBV BMLF-specific CD8+ T cells were detected using fluorescent-conjugated pentamer restricted to the PBMC donors' HLA/viral peptide (A*02:01/NLVPMVATV, SEQ ID NO:284), (A*02:01/GLCTLVAML, SEQ ID NO:285), respectively (ProImmune, Oxford, UK). PBMC was obtained from HemaCare (Van Nuys, Calif.) for donors with known CMV or EBV infection. PMBC from donors negative for the restricting HLA type was used as negative control. Staining was done as per manufacturer's protocol.

Quantification of CMV-Specific T-Cells

As indicated above Peripheral blood mononuclear cells (PBMCs) were isolated from blood of known CMV-infected human donors and added to plates containing the trispecific antibody or control antibody. The plates were incubated at 37° C. The cells were collected at specific time points and analyzed by flow cytometry.

Results

Figure 6A:
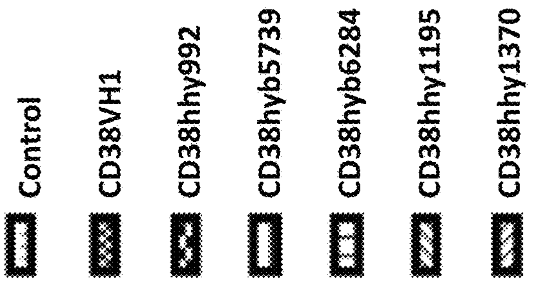
FIGS. 6A-6J show the characterization of in vitro T cell subset expansion in PBMCs collected from CMV-infected Donor D in response to CD38/CD28sup×CD3mid_ENLQ DKTHT IgG4 FALA trispecific antibodies with the indicated alternative anti-CD38 binding domains. A trispecific antibody lacking the CD38VH1 anti-CD38 binding domain was used as a negative control (ΔCD38VH1/ΔCD28sup×ΔCD3mid IgG4 FALA). T cell populations were measured at indicated time points (D3 refers to day 3; D7 refers to day 7). The indicated trispecific antibodies were tested at the indicated concentrations of 0.2 nM and 1 nM. Flow cytometry was used to quantify CMV-specific CD8+ T cells (FIGS. 6A-6B), CMV-specific $T_{cm}$ CD8+ cells (FIGS. 6C-6D), and CMV-specific $T_{em}$ CD8+ cells (FIGS. 6E-6F). In addition, the percentages of CMV-specific $T_{cm}$ (FIGS. 6G-6H) and $T_{em}$ (FIGS. 6I-6J) CD8+ cells were quantified at the indicated time points. All tested trispecific antibodies promoted the proliferation of CMV-specific memory CD8+ T cells with different potency and kinetics in a dose-responsive manner.
Figure 6A:
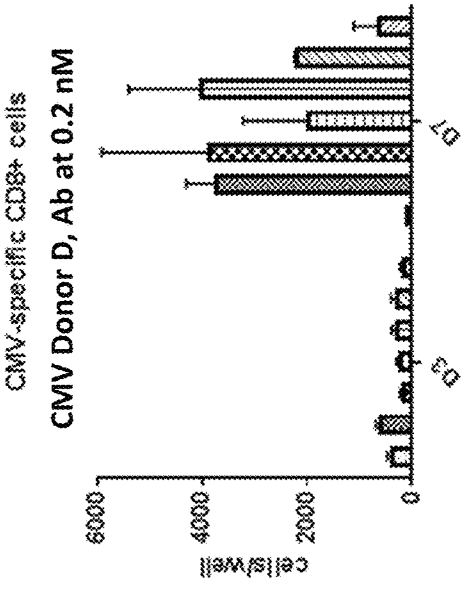
Figure 6B:
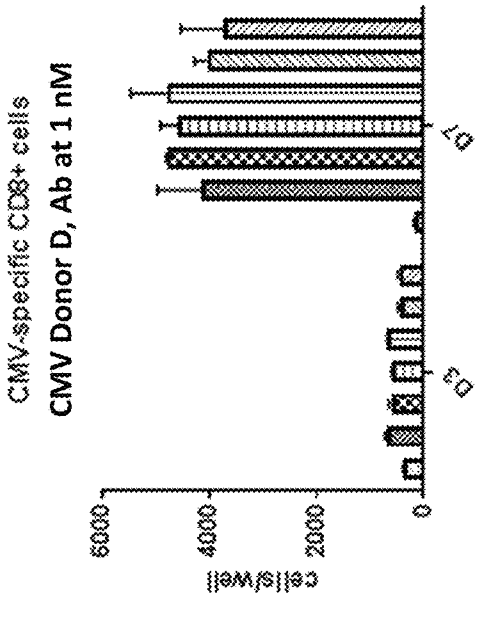
Figure 6C:
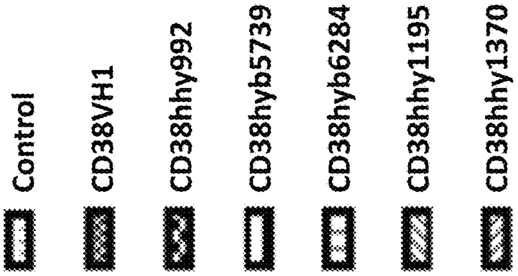
Figure 6C:
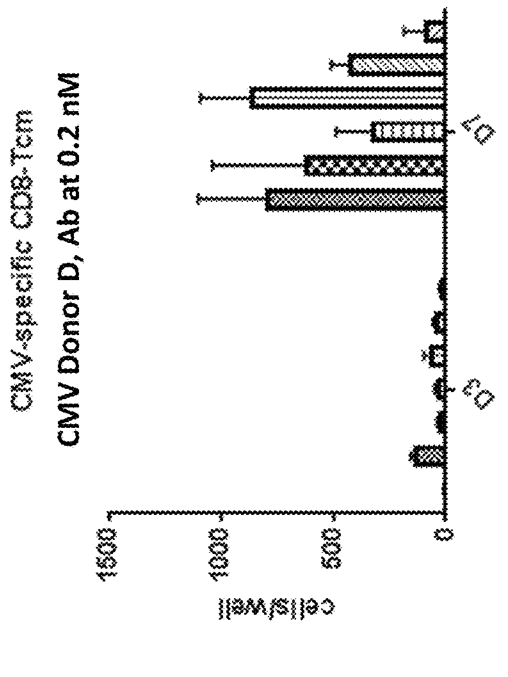
Figure 6D:
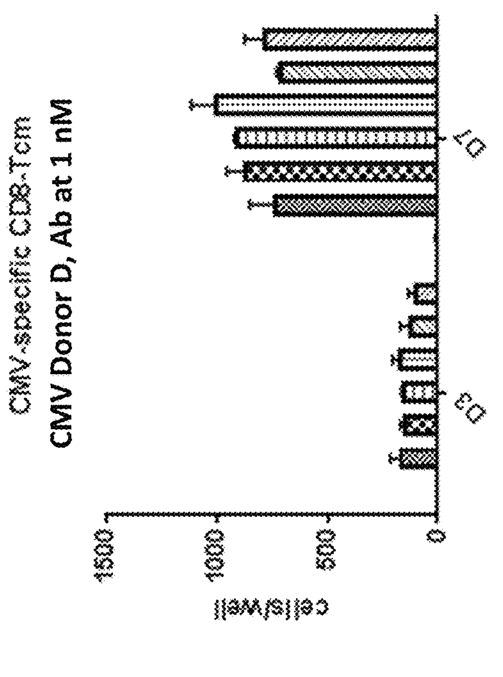
Figures 6E, 6F:
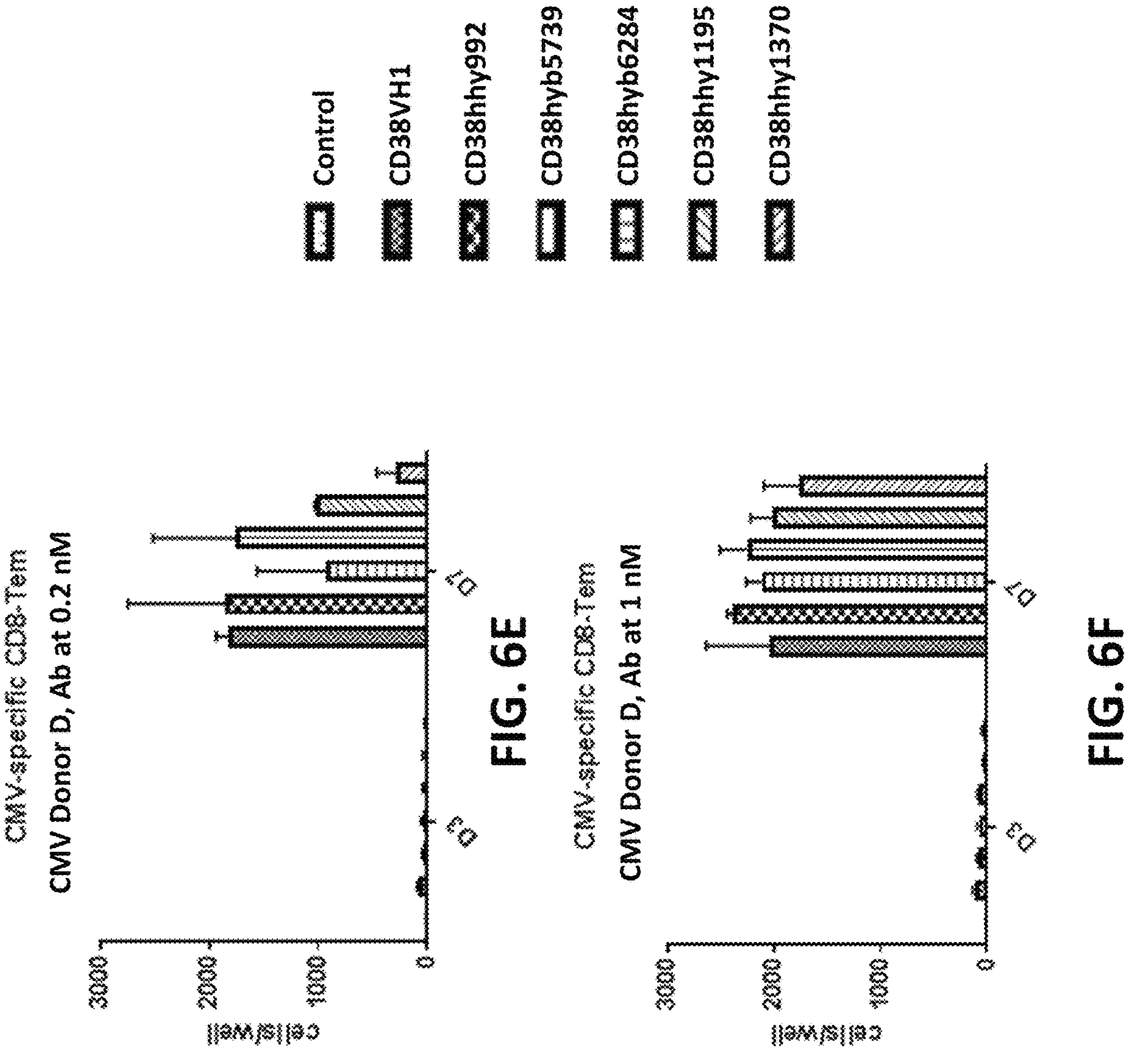
Figure 6G:
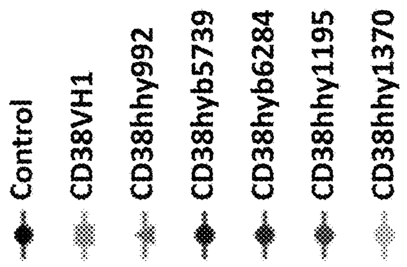
Figure 6G:
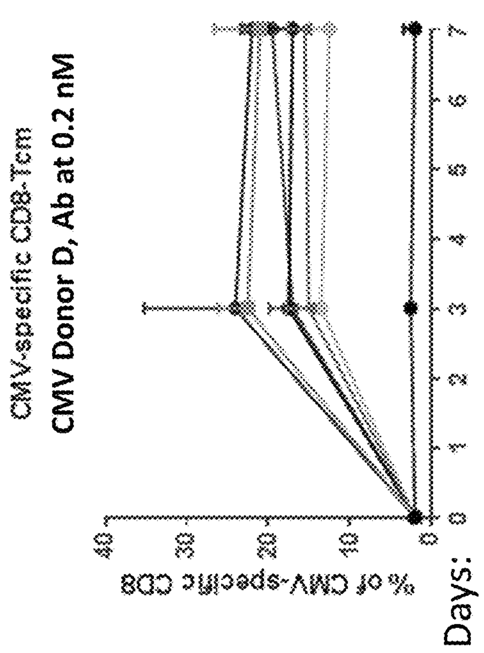
Figure 6H:
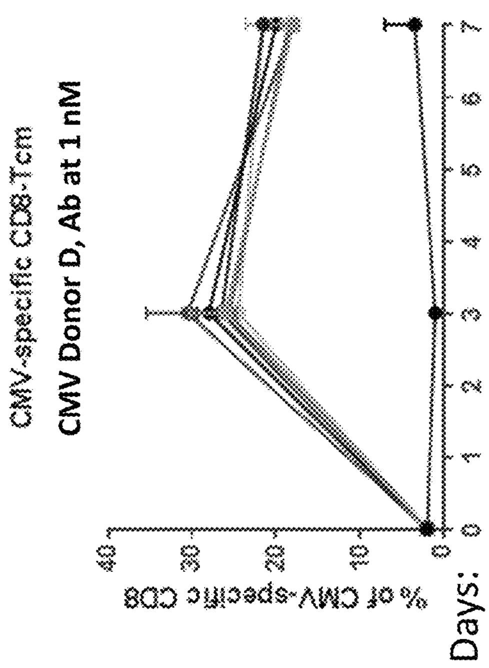
Figure 6I:
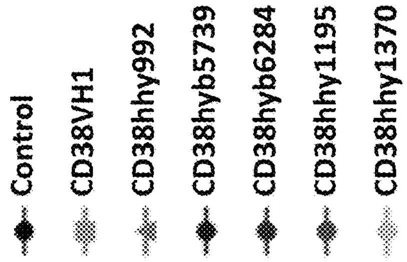
Figure 6I:
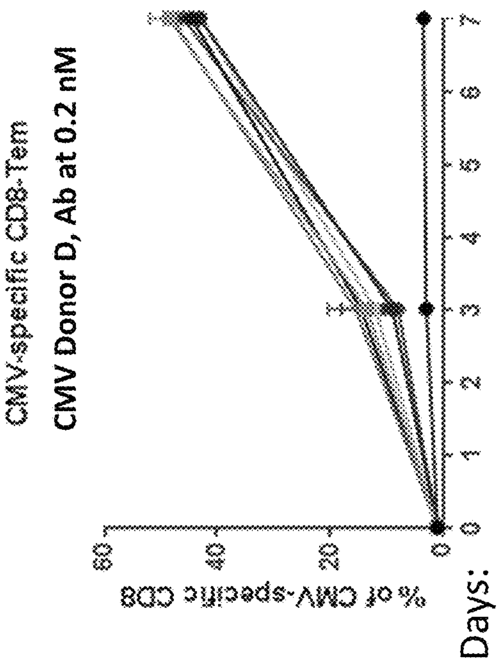
Figure 6J:
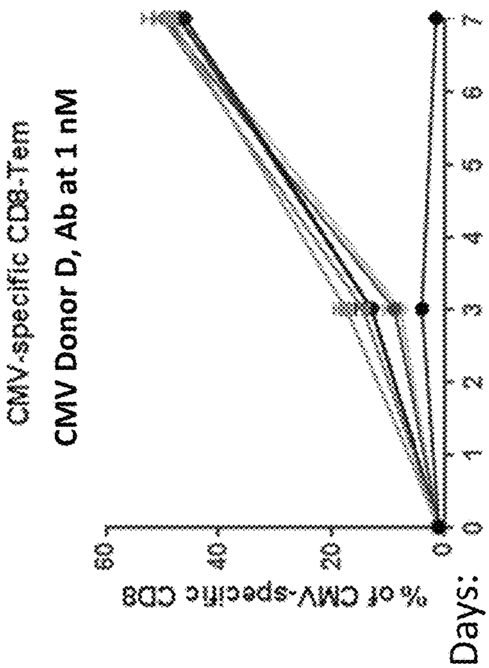
Figure 7A:
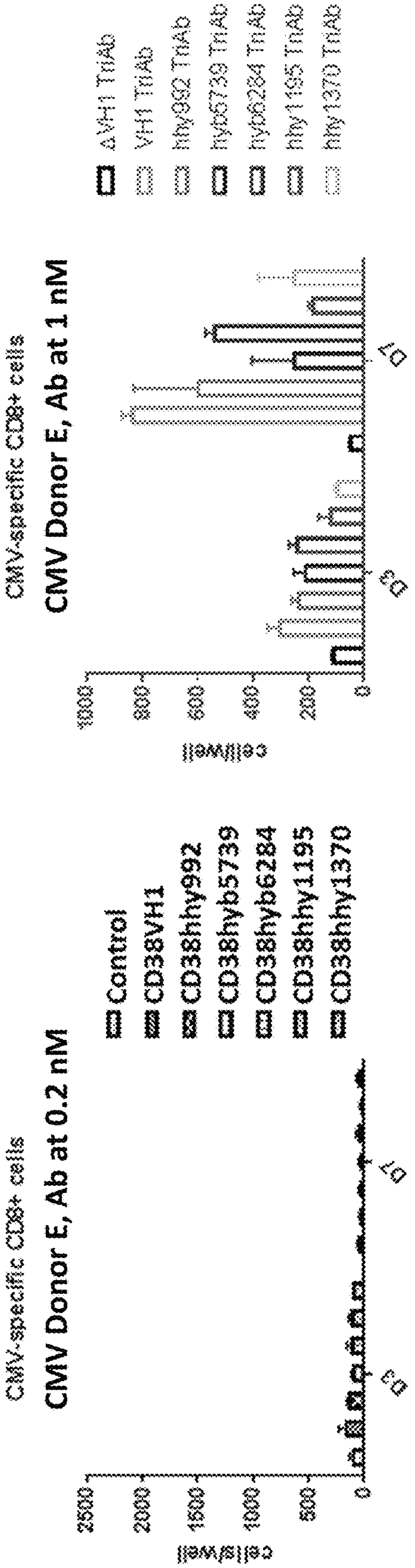
FIGS. 7A-7J show the characterization of in vitro T cell subset expansion in PBMCs collected from CMV-infected Donor E in response to CD38/CD28sup×CD3mid_ENLQ DKTHT IgG4 FALA trispecific antibodies with the indicated anti-CD38 binding domains. A trispecific antibody lacking the CD38VH1 anti-CD38 binding domain was used as a negative control (ΔCD38VH1/ΔCD28sup×ΔCD3mid IgG4 FALA). Antibodies shown in legend from top to bottom are shown in the graphs from left to right. T cell populations were measured at indicated time points (D3 refers to day 3; D7 refers to day 7). The indicated trispecific antibodies were tested at the indicated concentrations of 0.2 nM, 1 nM, and 2 nM. Flow cytometry was used to quantify CMV-specific CD8+ T cells (FIGS. 7A-7B), CMV-specific $T_{cm}$ CD8+ cells (FIGS. 7C-7D), and CMV-specific $T_{em}$ CD8+ cells (FIGS. 7E-7F). In addition, the percentages of CMV-specific $T_{cm}$ (FIGS. 7G-7H) and $T_{em}$ (FIGS. 7I-7J) CD8+ cells were quantified at the indicated time points. All tested trispecific antibodies promoted the proliferation of CMV-specific memory CD8+ T cells with different potency and kinetics in dose response manner.
Figure 7B:
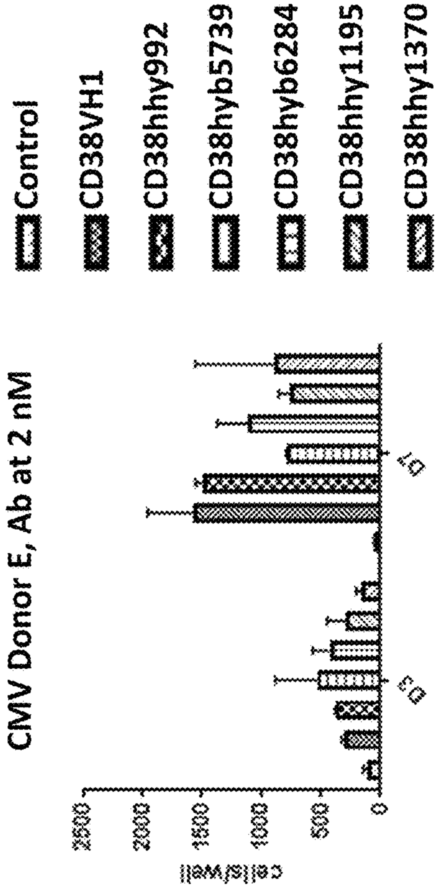
Figure 7C:
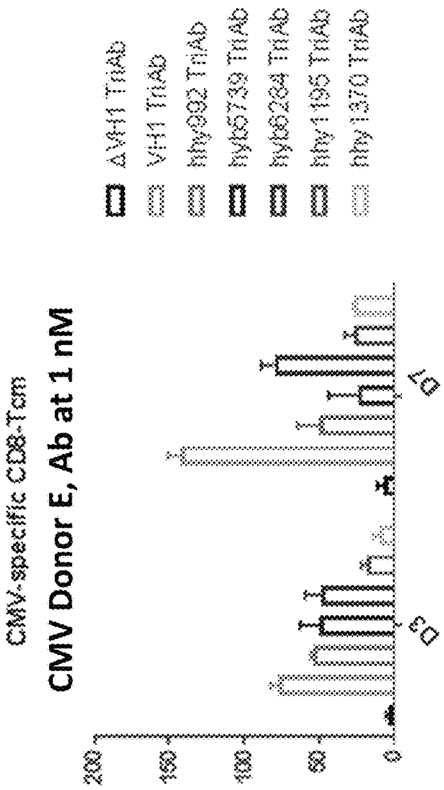
Figure 7D:
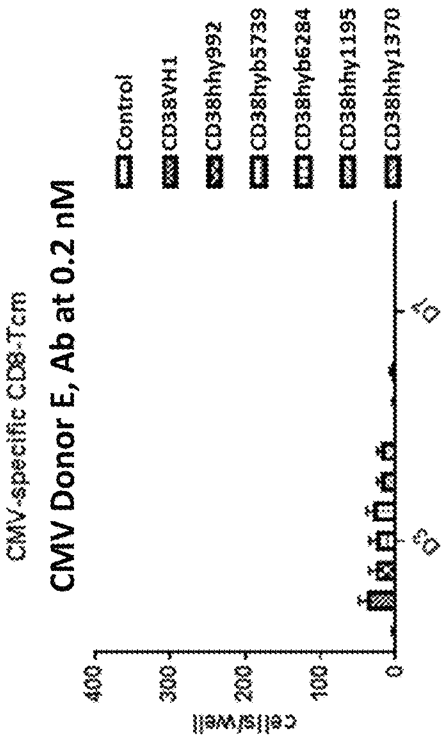
Figure 7D:
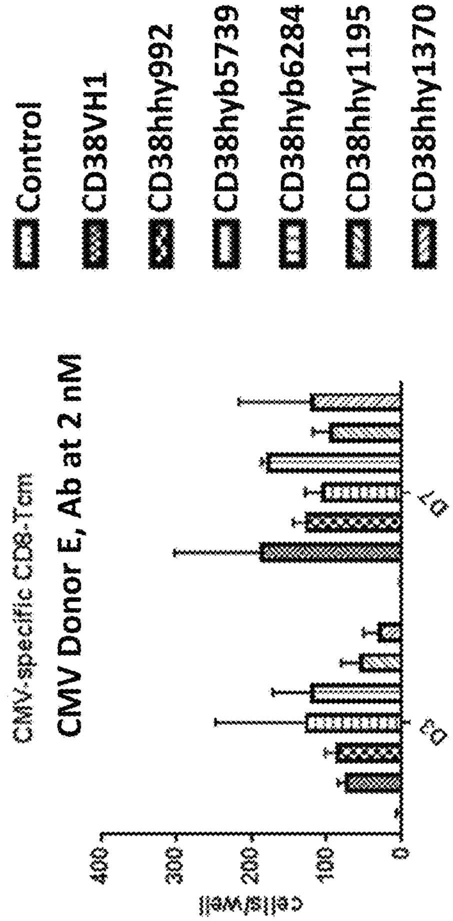
Figure 7E:
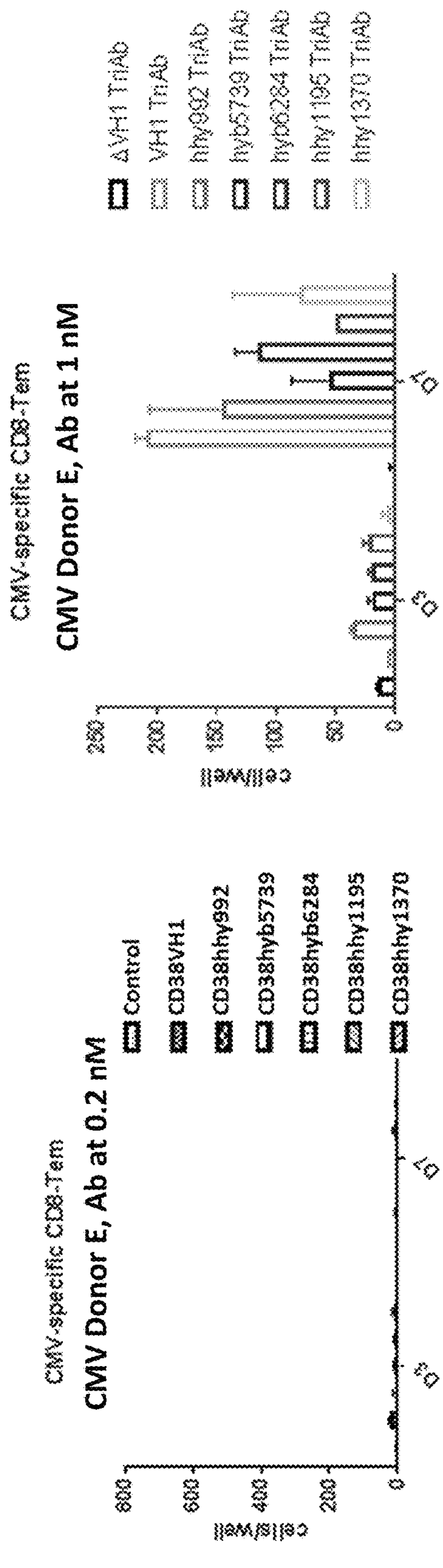
Figure 7F:
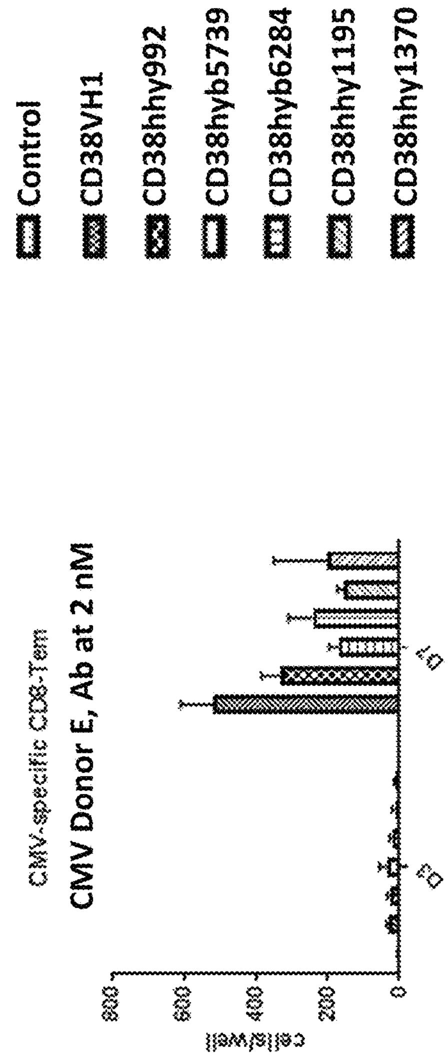
Figure 7G:
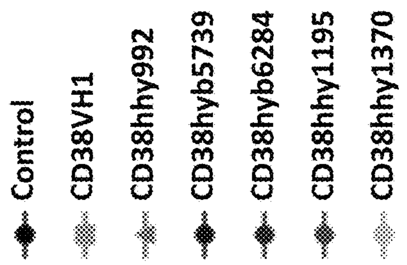
Figure 7G:
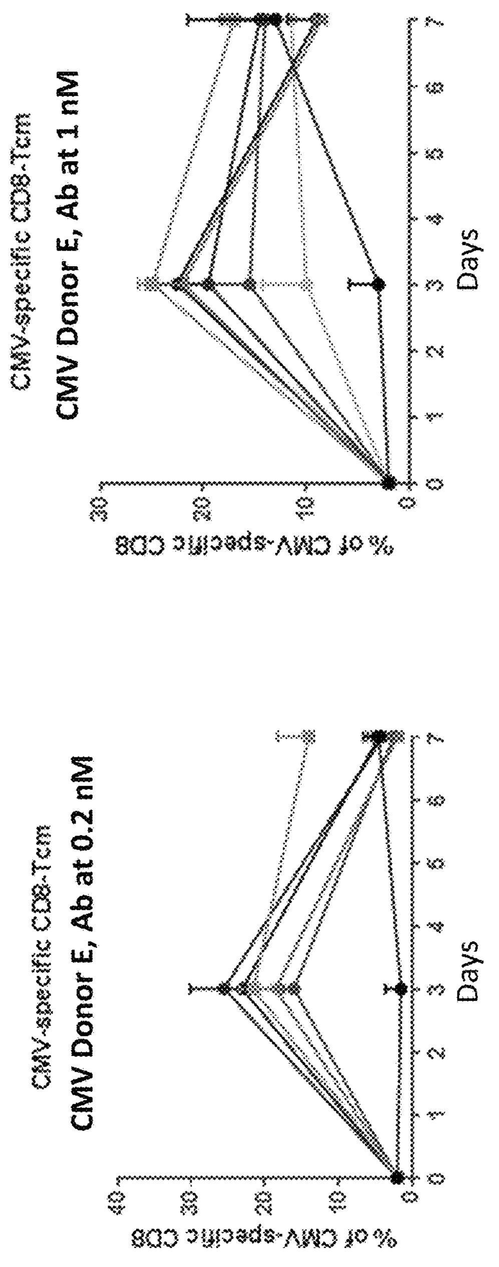
Figure 7H:
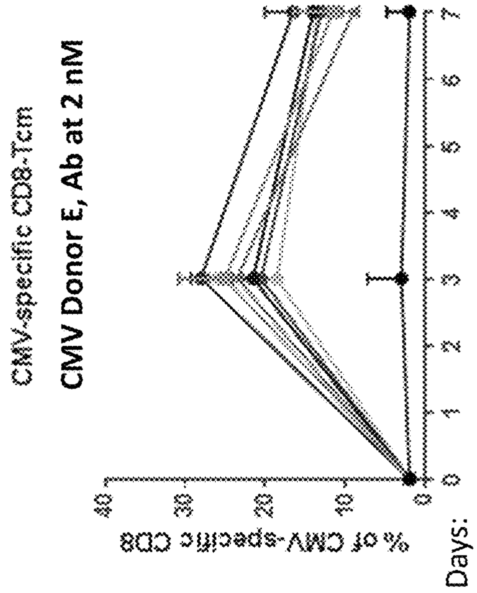
Figure 7I:
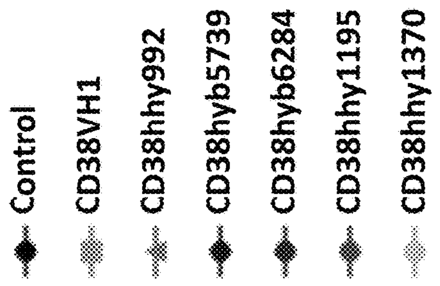
Figure 7I:
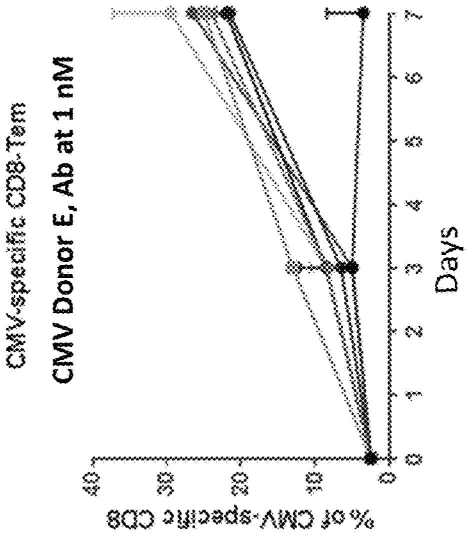
Figure 7J:
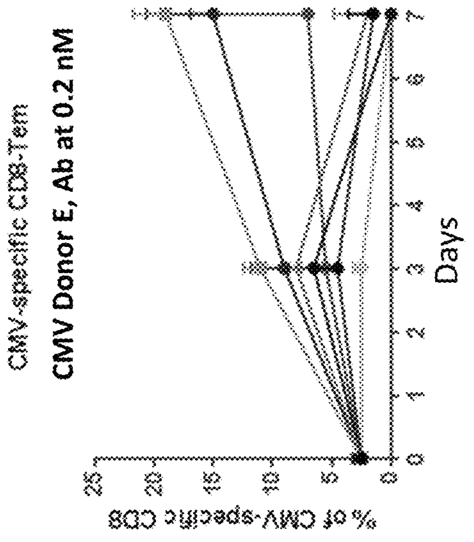
Figure 7J:
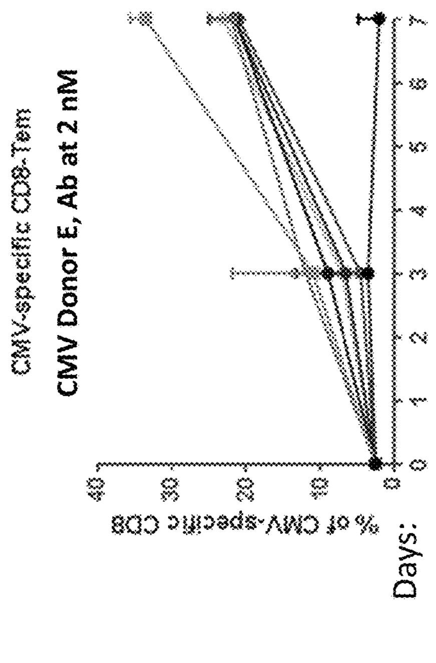

CD38/CD28sup×CD3mid_ENLQ DKTHT IgG4 FALA trispecific antibodies with alternative anti-CD38 binding domains ΔVH1CD38 (control), CD38VH1, CD38hhy992, CD38hyb5739, CD38hyb6284, CD38hhy1195, and CD38hhy1370 were tested as described above using PBMCs isolated from CMV-infected human donor D (FIGS. 6A-6J) and CMV-infected human donor E (FIGS. 7A-7J). All tested CD38 trispecific Abs activated and promoted the proliferation of CMV-specific T cells, leading to increases in CMV-specific CD8+ T cells (cells/well) with different potency and kinetics in a dose response manner over the 7 day experiment (CMV Donor D, FIGS. 6A-6B; CMV Donor E, FIGS. 7A-7B). In addition, all tested CD38 trispecific Abs promoted the amplification (cells/well) of CMV-specific central memory ($T_{cm}$) (CMV Donor D, FIGS. 6C-6D; CMV Donor E, FIGS. 7C-7D) and effector memory ($T_{em}$) CD8+ T cells (CMV Donor D, FIGS. 6E-6F; CMV Donor E, FIGS. 7E-7F), which were both amplified dramatically in 7 days. FIGS. 6G-6J (CMV Donor D) and FIGS. 7G-7J (CMV Donor E) provide time courses showing the percent of CMV-specific $T_{cm}$ and $T_{em}$ cells at days 0, 3, and 7 of the 7-day experiments described above.

Taken together, these data indicate that CD38/CD28×CD3 trispecific antibodies promote activation and expansion of CMV-specific T cells, such as CMV-specific CD8+ T cells, CMV-specific effector memory ($T_{em}$) CD8+ T cells, and CMV-specific central memory ($T_{cm}$) CD8+ T cells.

Example 5: CD38/CD28×CD3 Trispecific Antibodies Promote EBV-Specific Immune Response Next, the ability of CD38/CD28×CD3 trispecific antibodies to promote activation and expansion of Epstein-Barr virus (EBV)-specific T cells was determined.

Materials and Methods

Quantification of EBV-Specific T-Cells

As indicated above, peripheral blood mononuclear cells (PBMCs) were isolated from blood of known EBV-infected human donors and added to plates containing the trispecific antibody or control antibody. The plates were incubated at 37° C. for up to 11 days. The cells were collected at specific time points and analyzed by flow cytometry.

Results

Figure 8C:
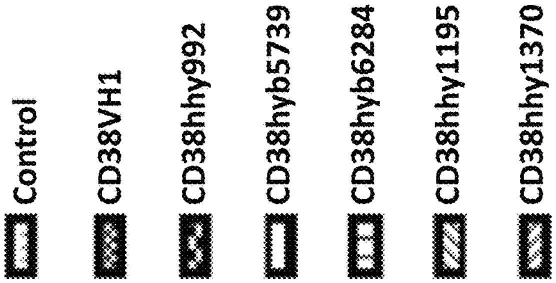
Figure 8C:
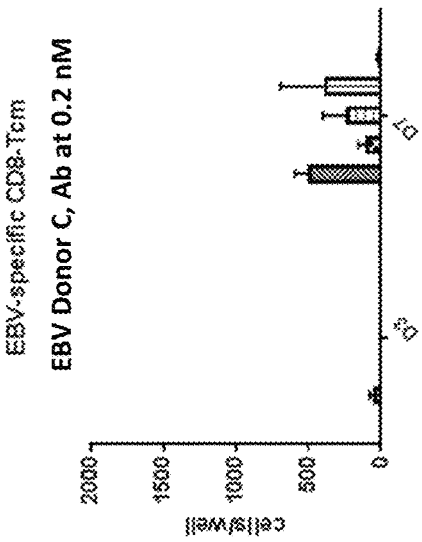
Figure 8D:
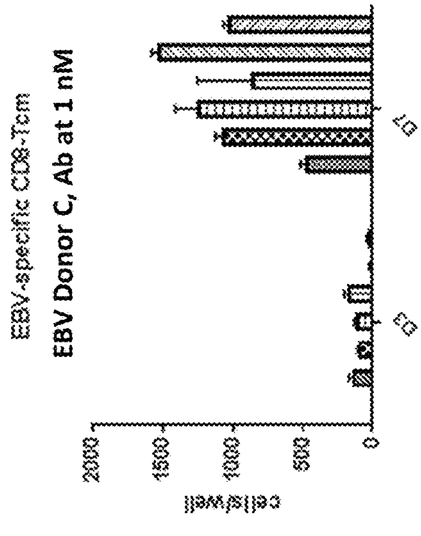
Figure 8E:
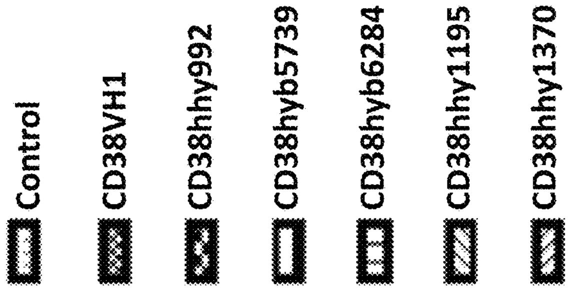
Figure 8E:
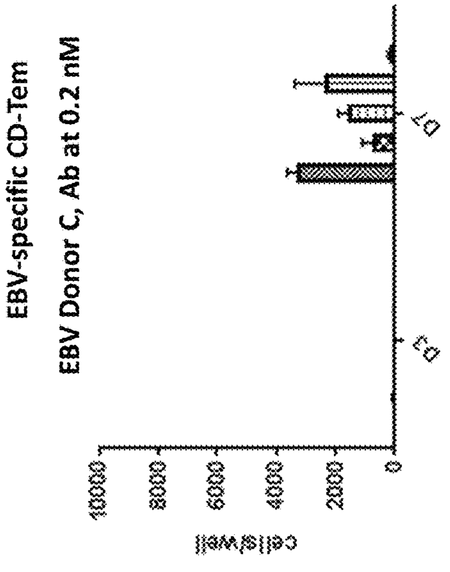
Figure 8F:
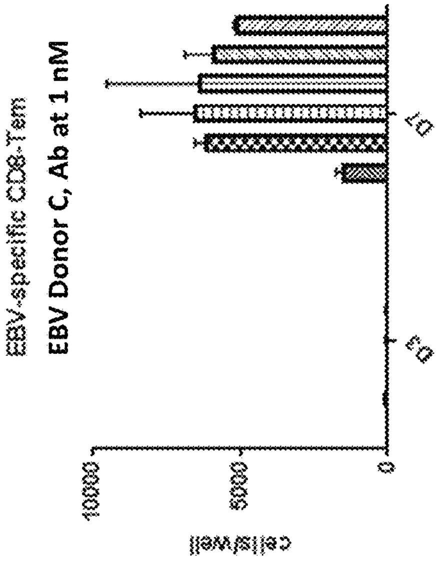
Figure 8G:
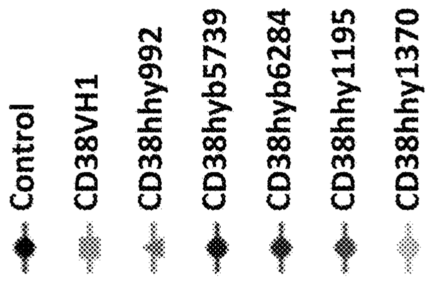
Figure 8G:
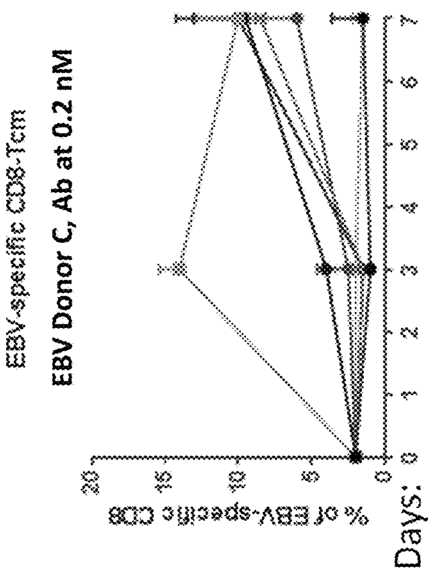
Figure 8H:
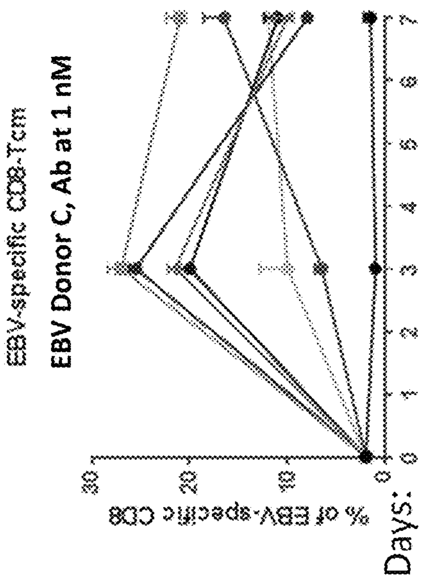
Figures 8I, 8J:
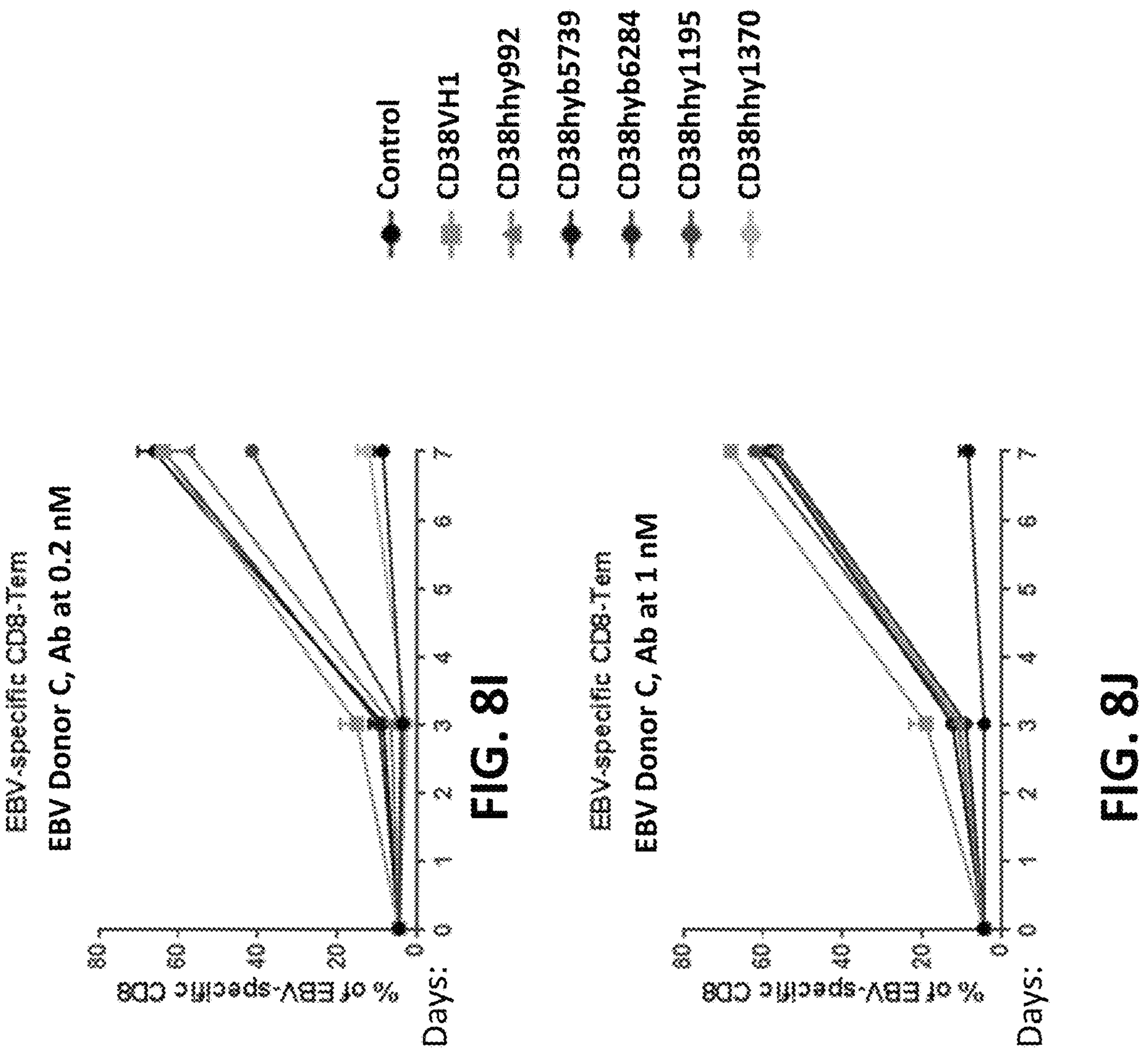
Figure 9A:
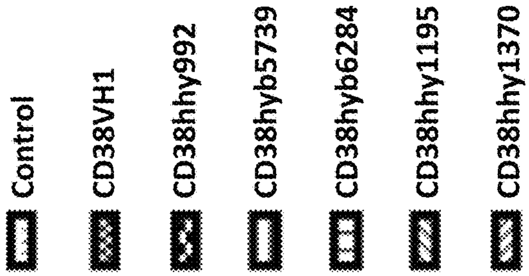
FIGS. 9A-12 show the characterization of in vitro T cell subset expansion in PBMCs collected from EBV-infected Donor D in response to CD38/CD28sup×CD3mid_ENLQ DKTHT IgG4 FALA trispecific antibodies with the indicated alternative anti-CD38 binding domains. A trispecific antibody lacking the CD38VH1 anti-CD38 binding domain was used as a negative control (ΔCD38VH1/ΔCD28sup×ΔCD3mid IgG4 FALA). T cell populations were measured at indicated time points (D3 refers to day 3; D7 refers to day 7). The indicated trispecific antibodies were tested at the indicated concentrations of 0.2 nM and 1 nM. Flow cytometry was used to quantify EBV-specific CD8+ T cells (FIGS. 9A-9B), EBV-specific $T_{cm}$ CD8+ cells (FIGS. 9C-9D), and EBV-specific $T_{em}$ CD8+ cells (FIGS. 9E-9F). In addition, the percentages of EBV-specific $T_{cm}$ (FIGS. 9G-10) and $T_{em}$ (FIGS. 11-12) CD8+ cells were quantified at the indicated time points. All tested trispecific antibodies promoted the proliferation of EBV-specific memory CD8+ T cells with different potency and kinetics in dose response manner.
Figure 9A:
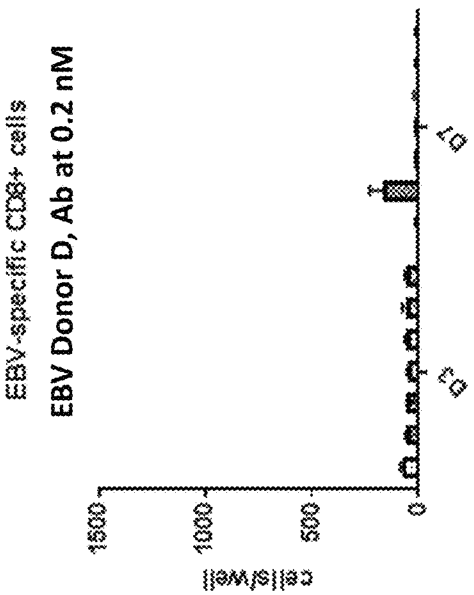
Figure 9B:
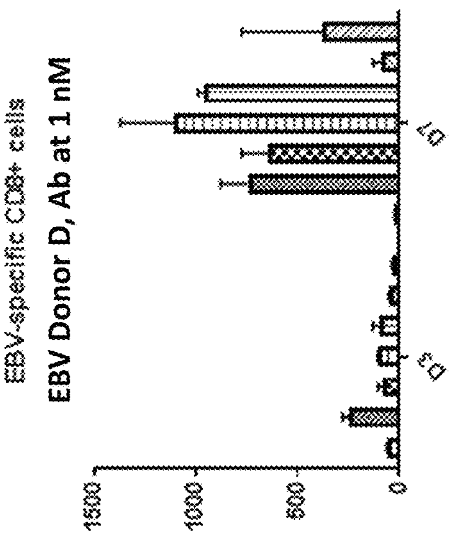
Figures 9C, 9D:
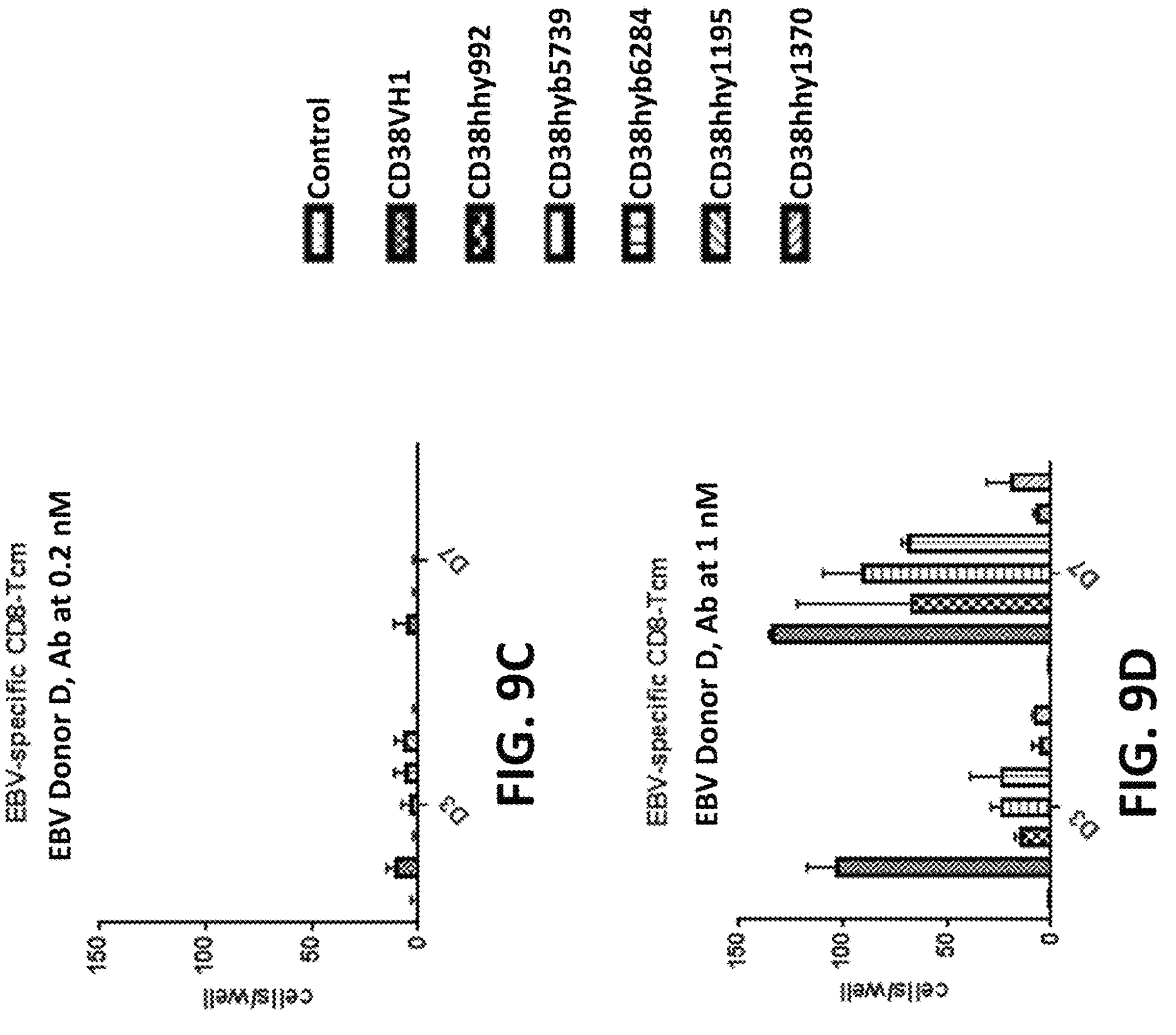
Figure 9E:
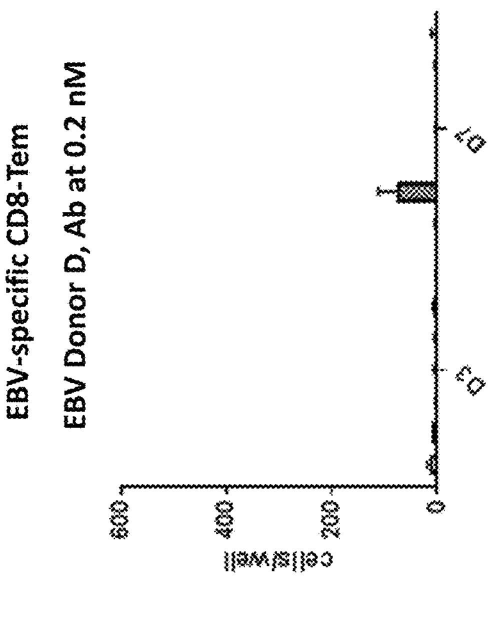
Figure 9F:
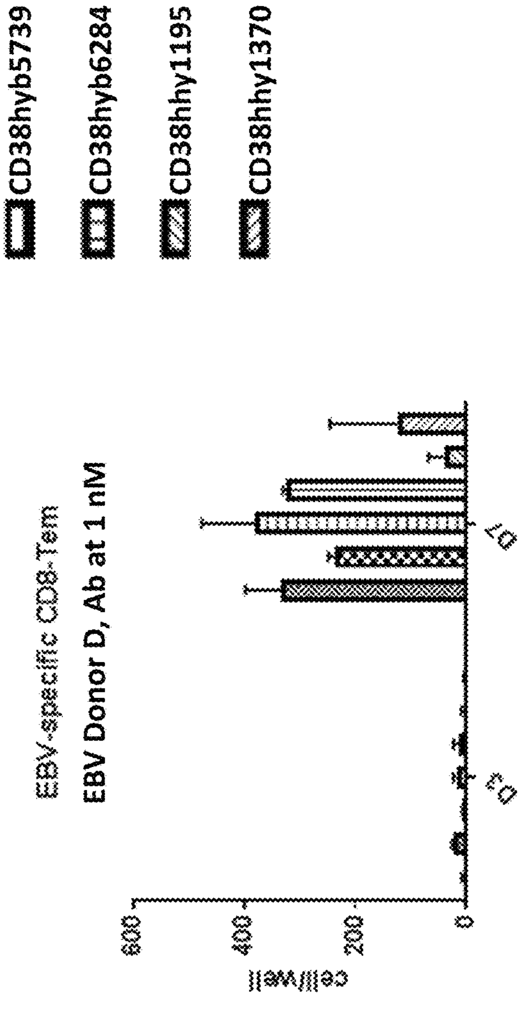
Figure 9G:
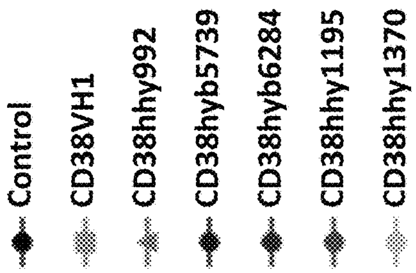
Figure 9G:
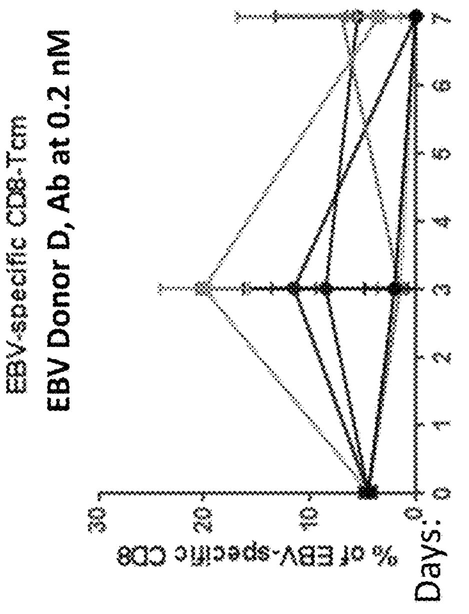
Figure 10:
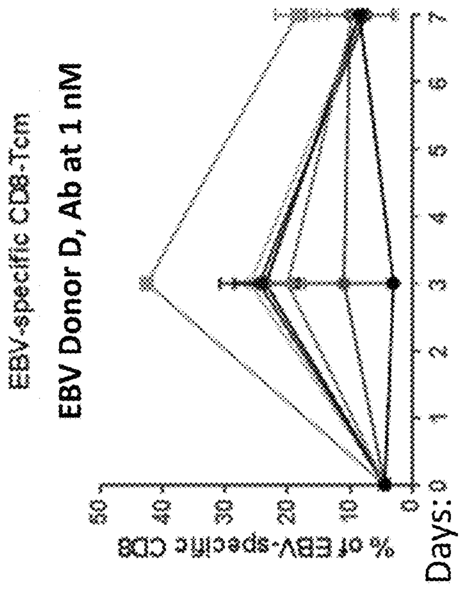
Figure 11:
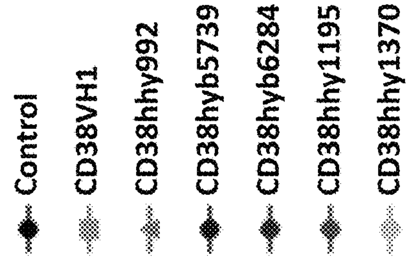
Figure 11:
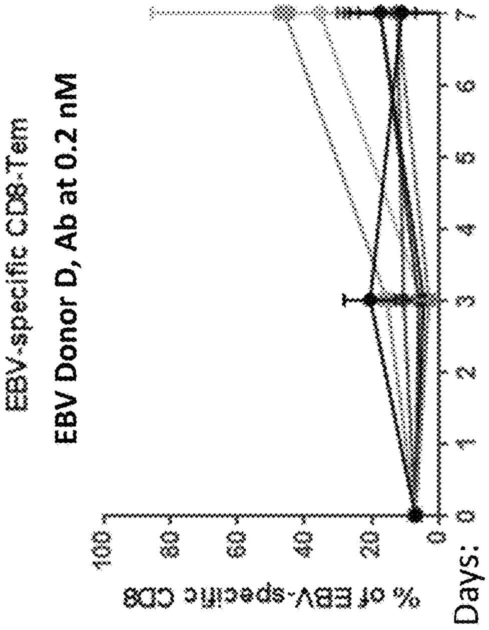
Figure 12:
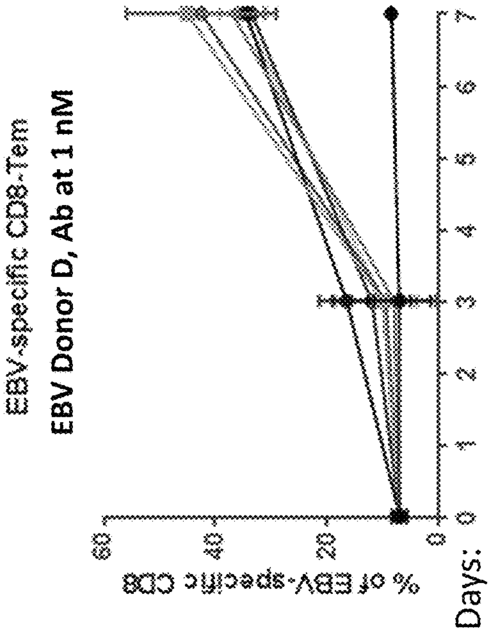

CD38/CD28sup×CD3mid_ENLQ DKTHT IgG4 FALA trispecific antibodies with alternative anti-CD38 binding domains ΔVH1CD38 (control), CD38VH1, CD38hhy992, CD38hyb5739, CD38hyb6284, CD38hhy1195, and CD38hhy1370 were also tested as described above using PBMCs isolated from EBV-infected donor C (FIGS. 8A-8J) and EBV-infected donor D (FIGS. 9A-12). All tested CD38 trispecific Abs activated T cells and promoted the proliferation of EBV-specific T cells, leading to increases in EBV-specific CD8+ T cells (cells/well) with different potency and kinetics in a dose response manner over the 7 day experiment (EBV Donor C, FIGS. 8A-8B; EBV Donor D, FIGS. 9A-9B). In addition, all tested CD38 trispecific Abs promoted the amplification (cells/well) of EBV-specific central memory ($T_{cm}$) (EBV Donor C, FIGS. 8C-8D; EBV Donor D, FIGS. 9C-9D) and effector memory ($T_{em}$) CD8+ T cells (EBV Donor C, FIGS. 8E-8F; EBV Donor D, FIGS. 9E-9F), which were both amplified dramatically in 7 days. FIGS. 8G-8J (EBV Donor C) and FIGS. 9G-12 (EBV Donor D) provide time courses showing the percent of EBV-specific $T_{cm}$ and $T_{em}$ cells at days 0, 3, and 7 of the 7-day experiments described above.

Taken together, these data indicate that CD38/CD28×CD3 trispecific antibodies promote activation and expansion of EBV-specific T cells, such as EBV-specific CD8+ T cells, EBV-specific effector memory ($T_{em}$) CD8+ T cells, and EBV-specific central memory ($T_{cm}$) CD8+ T cells.

Example 6: Anti-Tumor Effects of Her2/CD28×CD3 Trispecific Antibody in Tumor-Bearing Mice In this Example, the Her2/CD28×CD3 trispecific antibody was tested for anti-tumor effects in a ZR-75-1 tumor bearing Nod scid gamma (NSG) mouse model engrafted with in vitro expanded T cells.

Materials and Methods

NSG mice were divided into 5 groups of 10 mice each. On Day 0, ZR-75-1 human breast cancer cells were implanted into the mammary fat pad with 50% matrigel into each mouse at 5 million cells/mouse. On Days 17/18, expansion of human CD3+ T cells was begun. Randomization of mice occurred on Day 24 when tumors were approximately 150 $mm^3$. On Day 25, all mice were engrafted with in vitro expanded human CD3+ T cells at 10 million cells in 300 μL/mouse (1QW, 1 IP injection).

Starting on Day 25, one group of mice received doses of vehicle alone (8% w/v sucrose, 0.05% w/v polysorbate 80, 10 mM histidine, pH 5.5), while the other 4 groups received Her2/CD28×CD3 trispecific antibody, both at 10 mL/kg. Groups receiving trispecific antibody were dosed at 100, 10, 1, or 0.1 μg/kg. Antibody or vehicle was administered 1QW intravenously in 2 doses (e.g., Days 25 and 32). Blood and tumor tissue was collected on Day 38 or 39.

Results

Figure 13A:
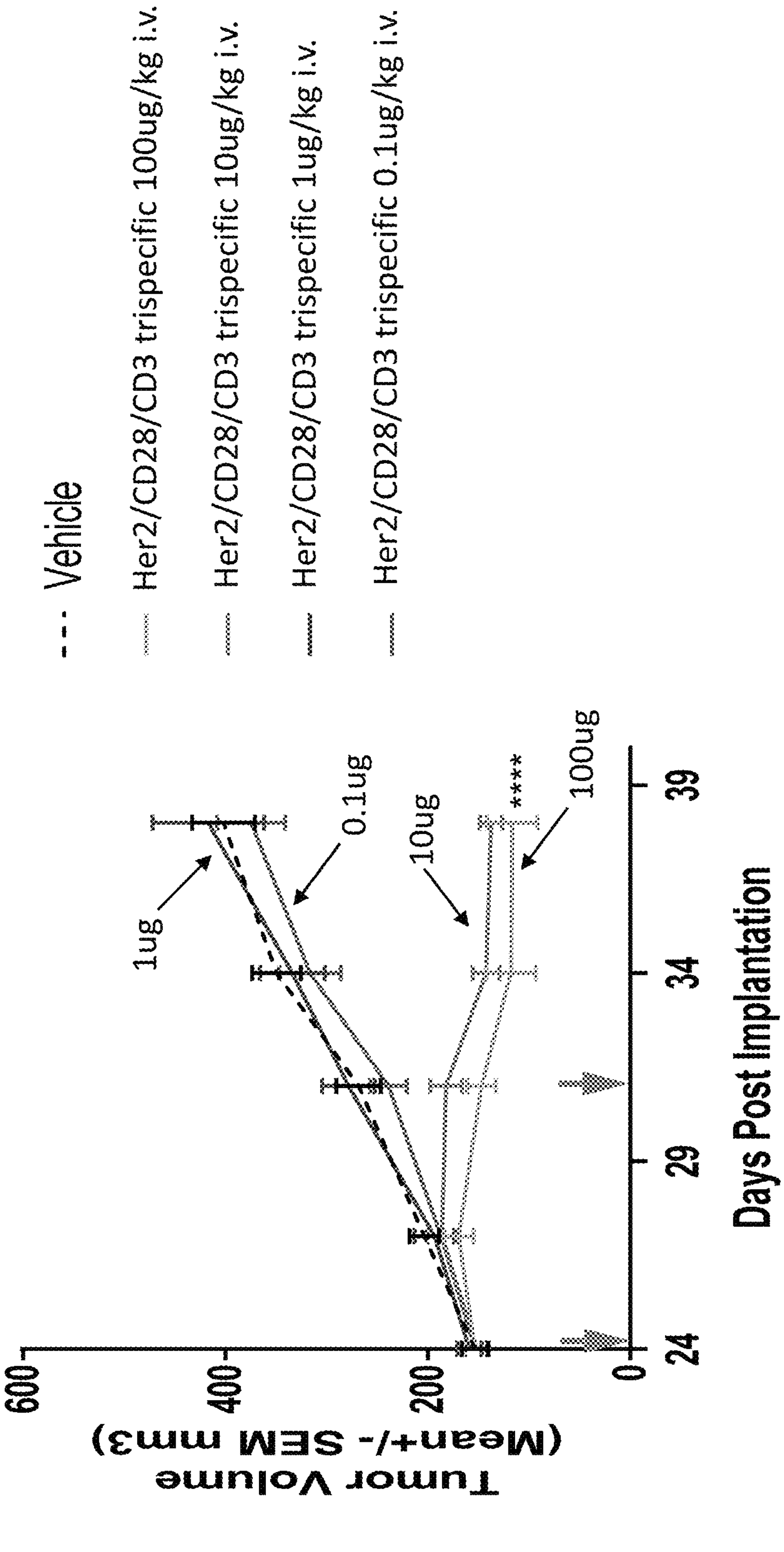
FIGS. 13A-13D show the change over time (days) in tumor volume (FIG. 13A) and body weight (FIG. 13B) in ZR-75-1 tumor bearing NSG mice engrafted with in vitro expanded human CD3+ T cells. Groups of 10 mice were either treated with vehicle or Her2/CD28×CD3 trispecific antibody at the indicated dosages. Arrow heads indicate days of administration. Tumor volume is depicted as mean±SEM, $mm^3$. Body weight change is depicted as % change, mean±SEM. X-axis shows days after implantation with ZR-75-1 cells. Tumor volume ($mm^3$) over time for individual mice in each treatment group are shown in FIG. 13C. Tumor weight (mg) for each treatment group is shown in FIG. 13D. =p<0.001; *=p<0.0003 (two-way ANOVA, control vs. 100 & 10 ug/kg).
Figure 13B:
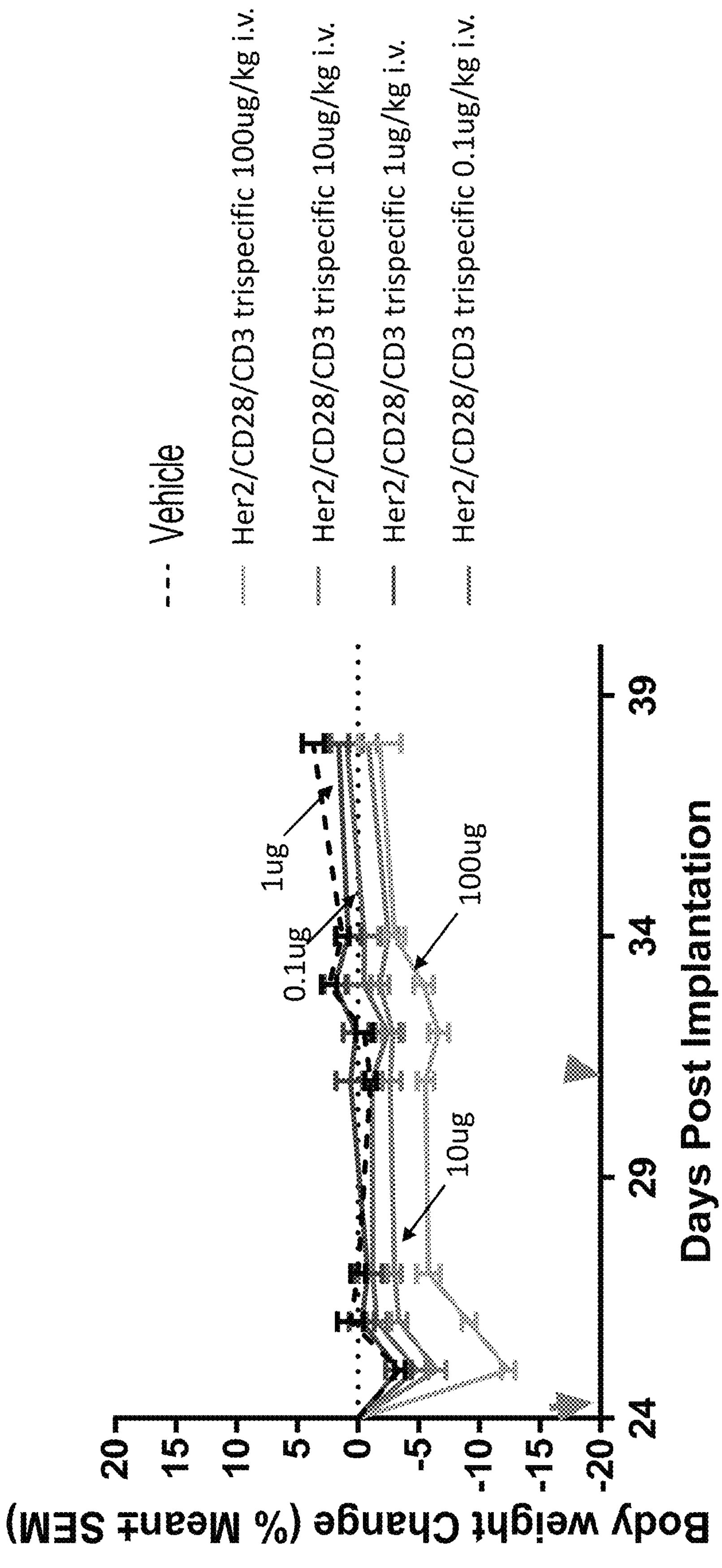
Figure 13C:
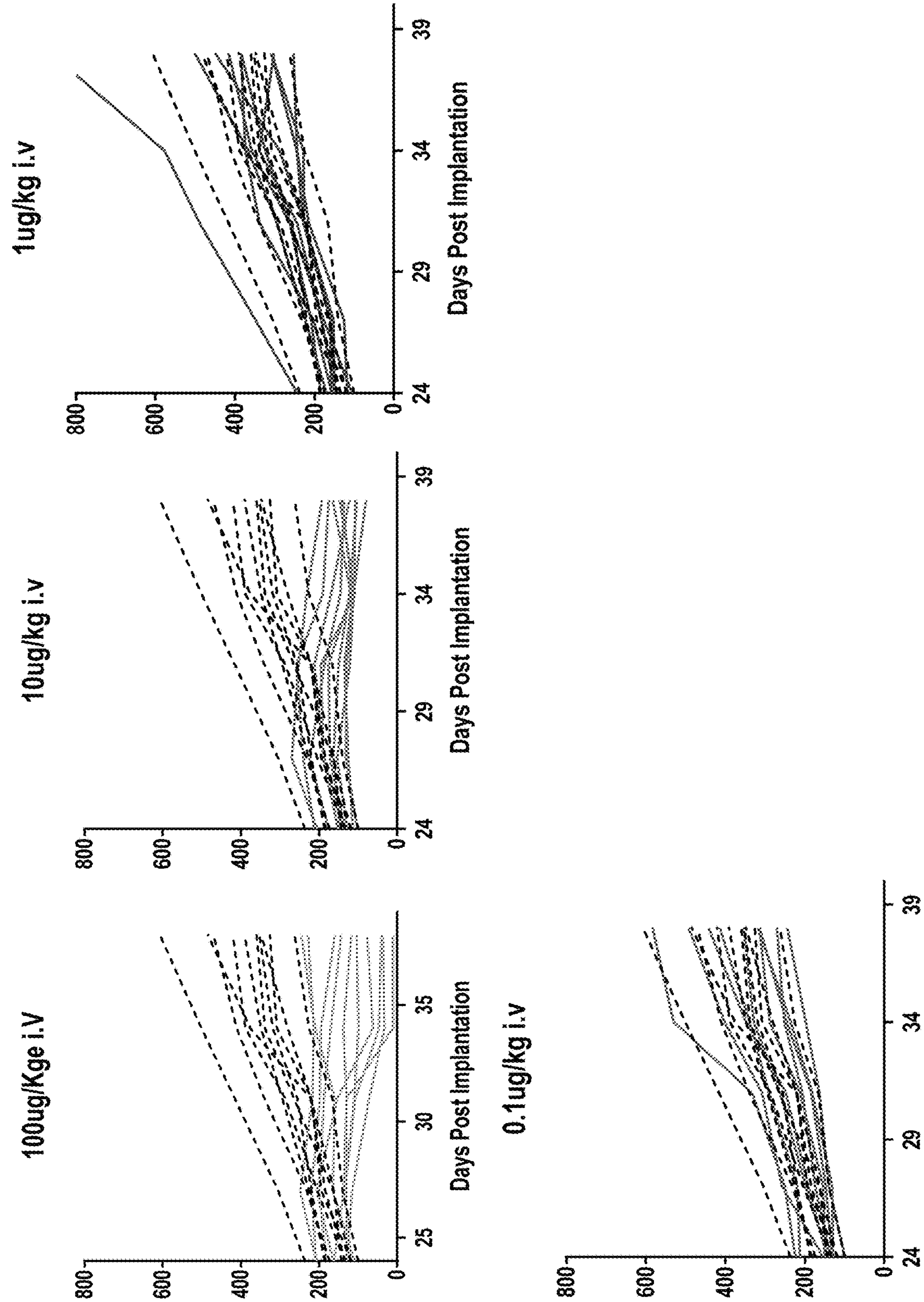
Figure 13D:
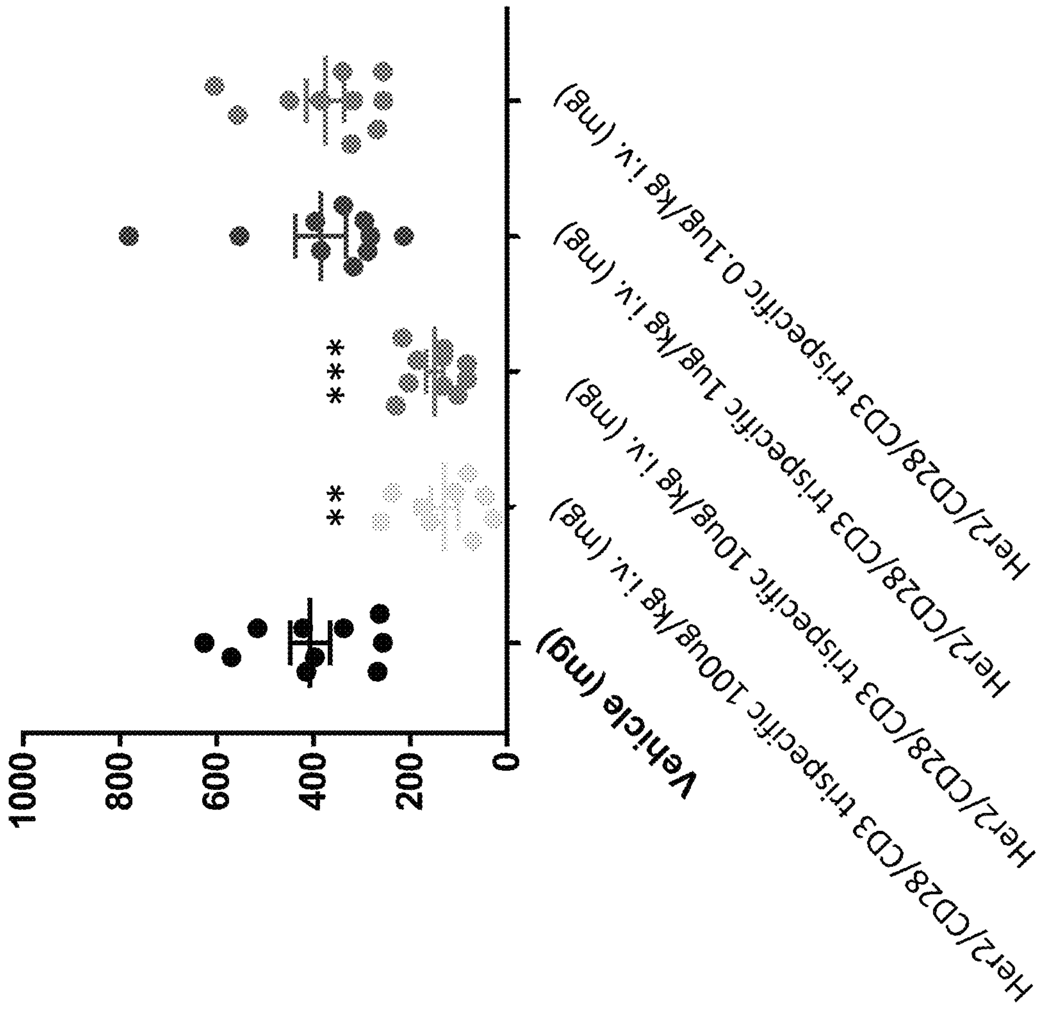

Her2/CD28×CD3 trispecific antibody (binding protein #2 from Table 1, corresponding to SEQ ID Nos:104-107) was compared to vehicle control for its effects on human breast tumor growth in the NSG mouse model engrafted with in vitro expanded human T cells described above. Treatment with Her2/CD28×CD3 trispecific antibody at the highest dose (100 ug/kg) led to the most significant inhibition of tumor growth and regression, although the 10 ug/kg dose also showed anti-tumor effects (FIGS. 13A & 13D). No significant body weight loss was observed (FIG. 13B). Individual tumor volumes over time from each trispecific antibody treatment group are provided in FIG. 13C.

Figure 14A:
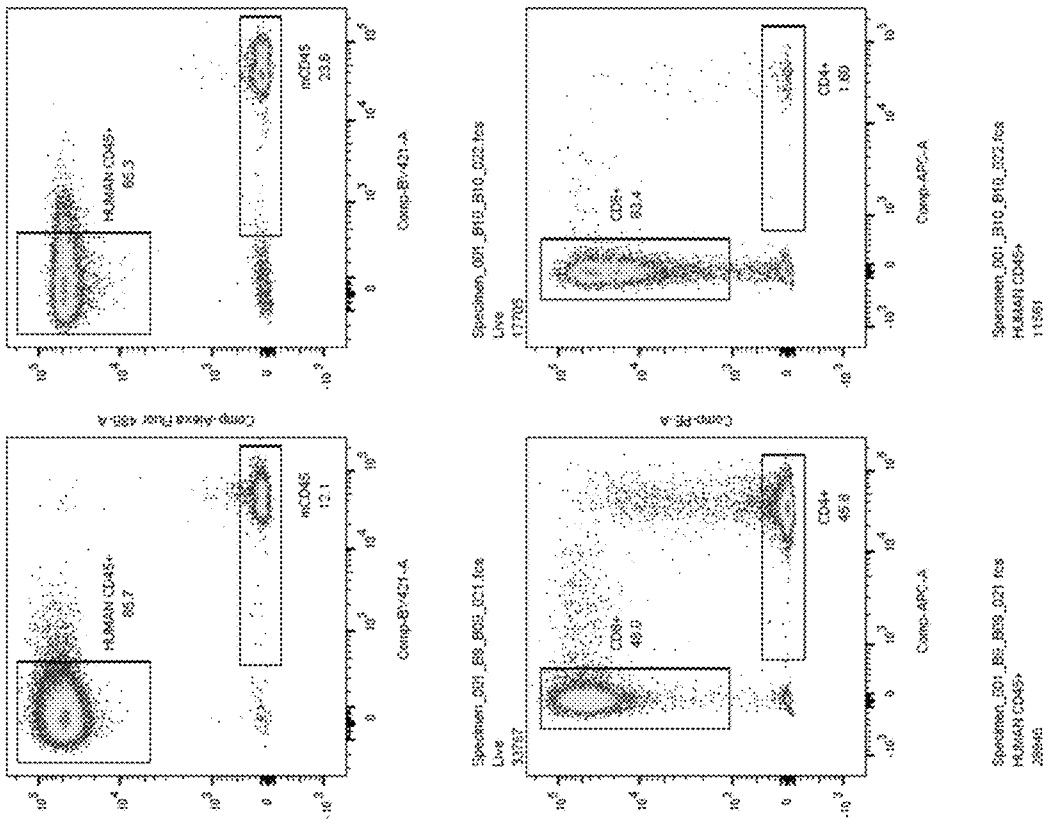
FIGS. 14A-14C show the effect of Her2/CD28×CD3 trispecific antibody treatment on T cells from whole blood.
Figure 14B:
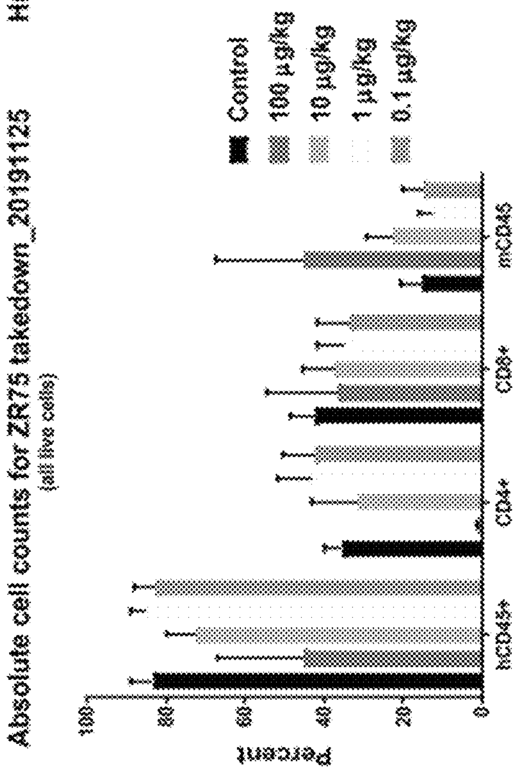
Figure 14C:
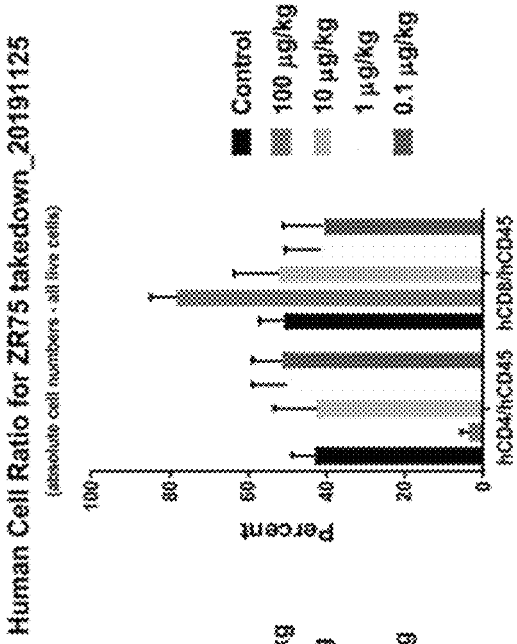

Next, the effect of trispecific antibody treatment on individual immune cell subsets was examined. Human CD45+, human CD8+, and human CD4+ cell populations were measured by flow cytometry, as well as mouse CD45+ cells (FIGS. 14A-14C). Highest dose (100 ug/kg) of trispecific antibody led to depletion of human CD4+ cells, and this effect was dose dependent (FIGS. 14B & 14C). Counts of human CD8+ cells were largely unaffected by trispecific antibody administration.

Figure 15A:
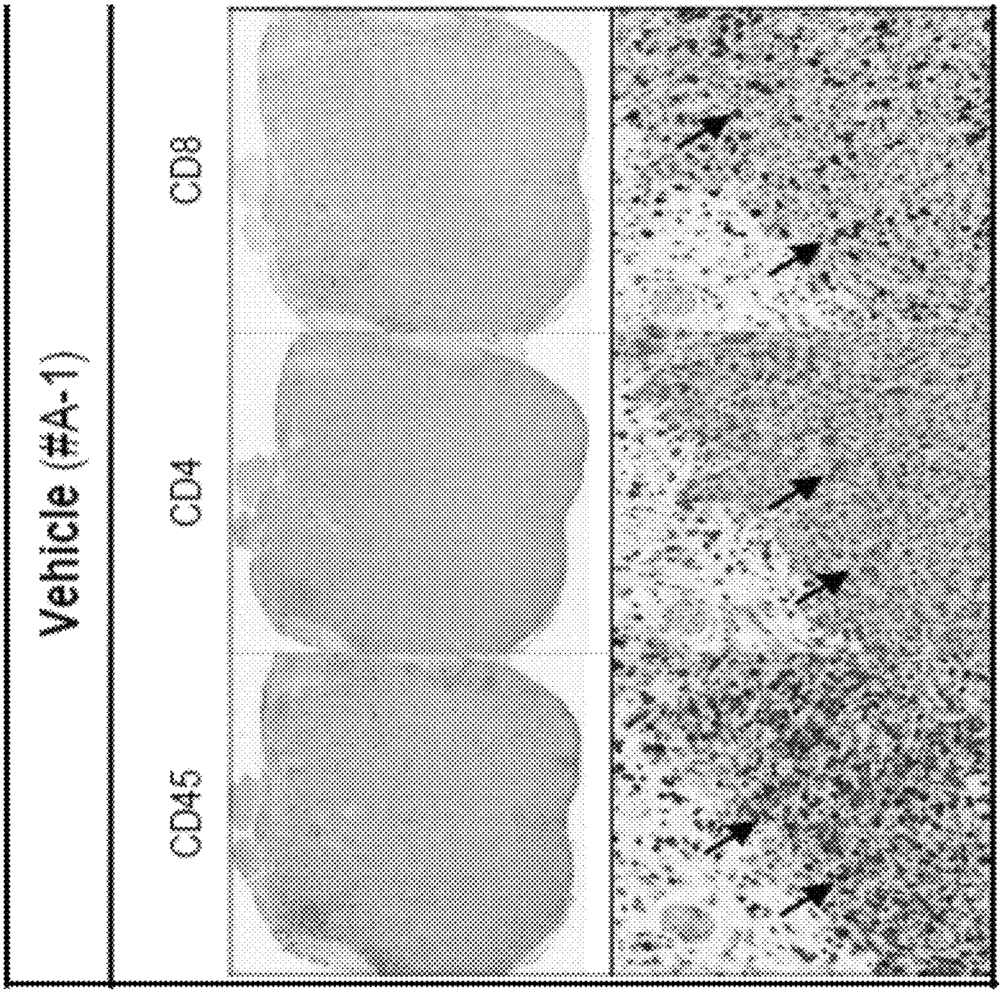
FIGS. 15A-15C show the effect of Her2/CD28×CD3 trispecific antibody treatment on tumor infiltrating lymphocytes (TILs), as examined by immunohistochemistry (IHC). Arrows indicate tumor infiltrating T cells identified in ZR-75-1 breast tumors. Upper images are at 1× magnification; lower images are at 20× magnification. In both sets of images, staining for human CD45, human CD4, and human CD8 are shown from left to right. Shown are tumors from mice treated with vehicle control (FIG. 15A), 100 ug/kg trispecific antibody (FIG. 15B), or 0.1 ug/kg trispecific antibody (FIG. 15C).
Figure 15B:
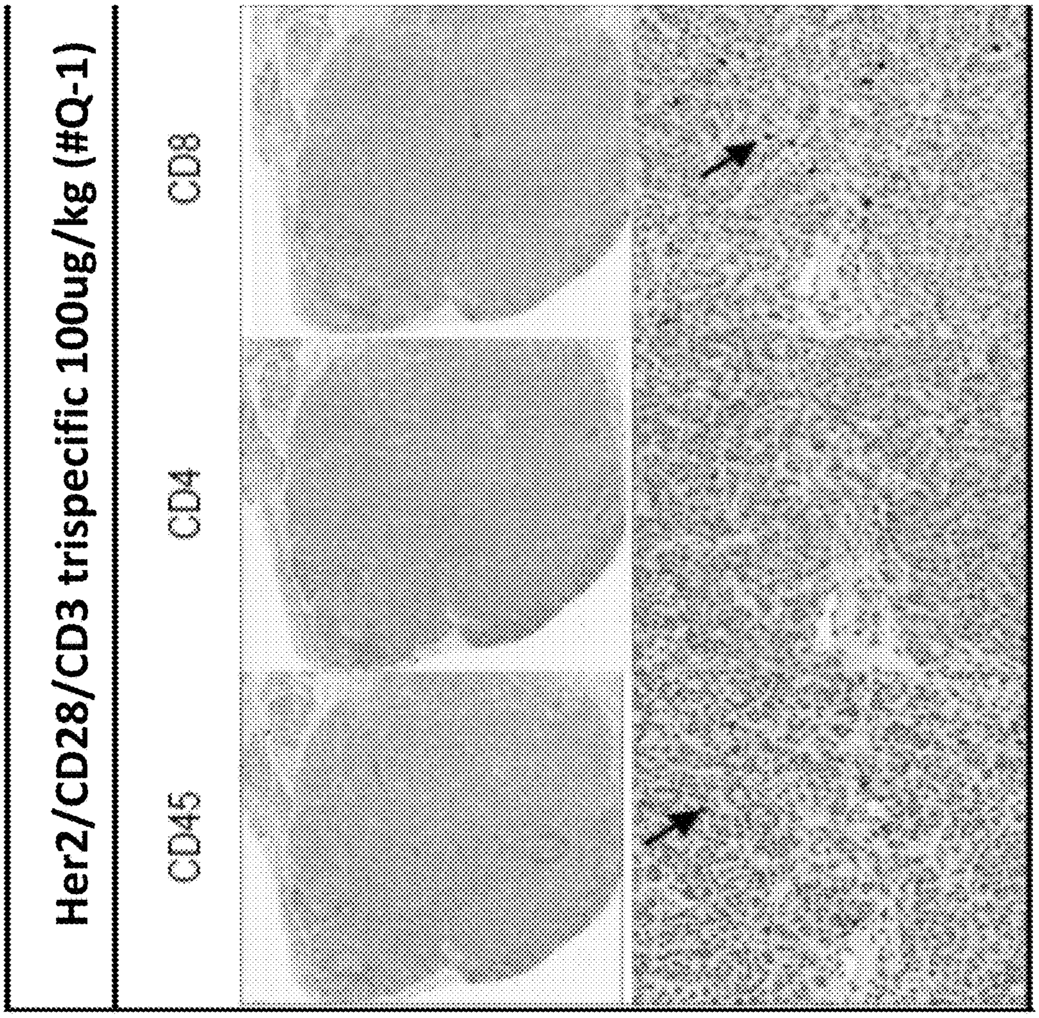
Figure 15C:
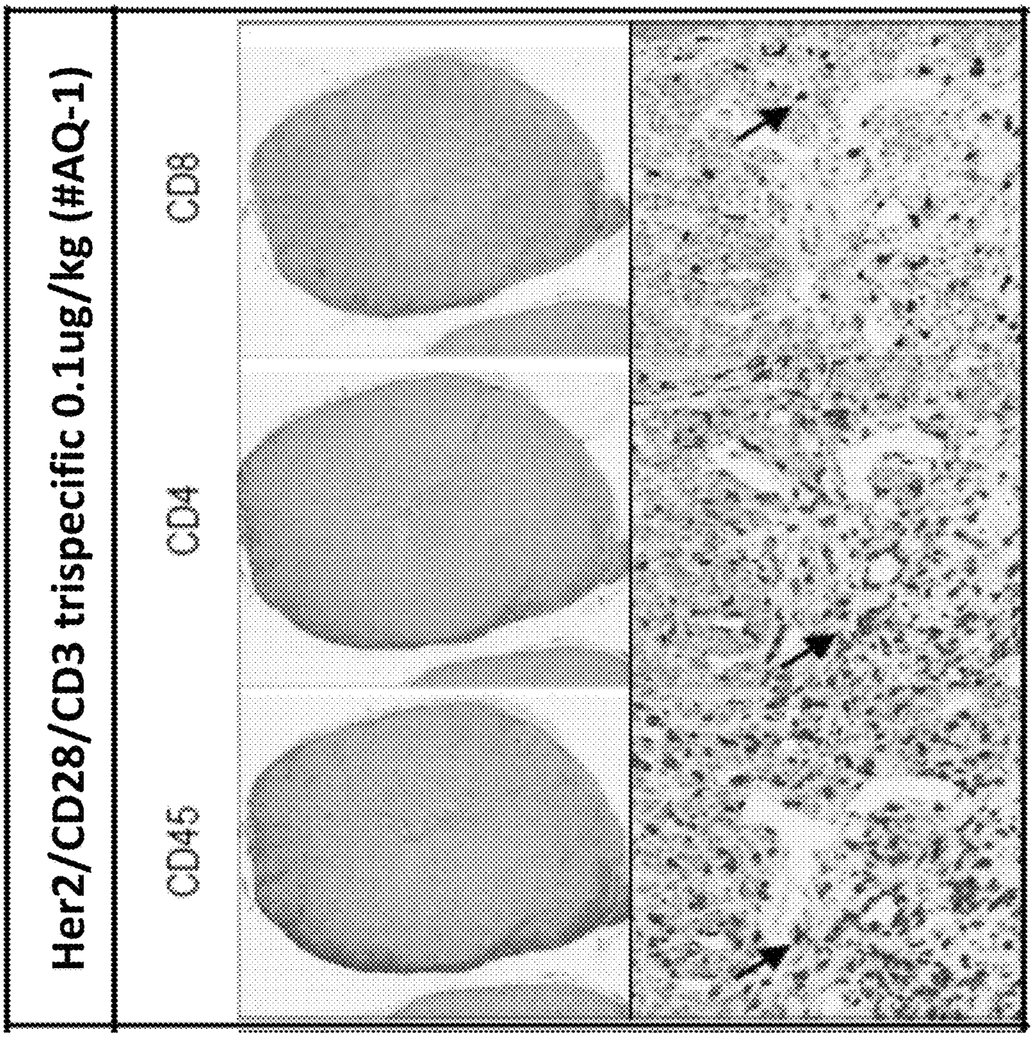
Figure 16A:
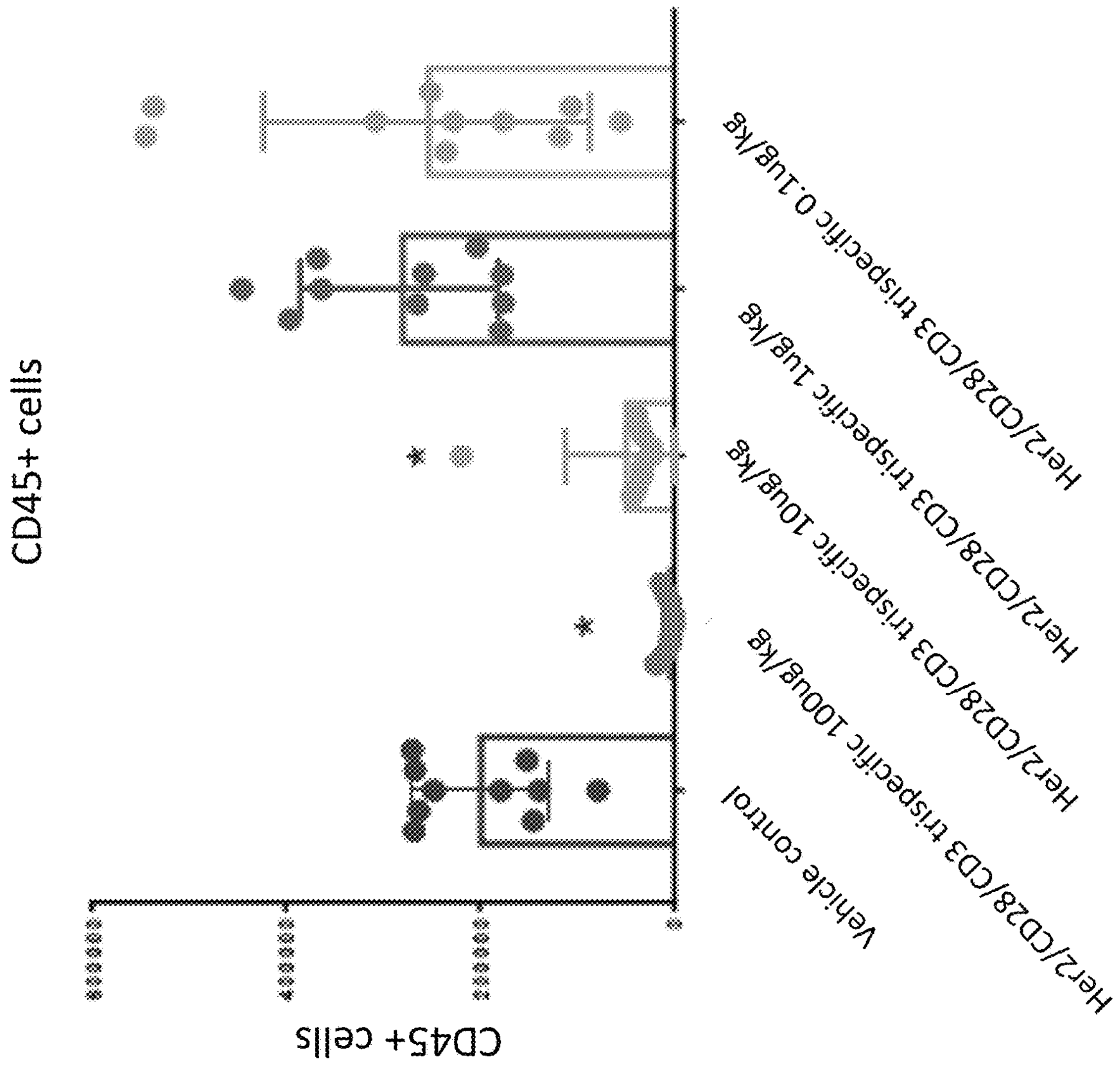
FIGS. 16A-16C show quantitation of the effect of Her2/CD28×CD3 trispecific antibody treatment on TILs as measured by IHC. Each dot represents one tumor from an individual mouse; rectangles represent group means; and error bars indicate standard deviation. *=p<0.05 compared to vehicle control group (ANOVA). Numbers of CD45+ (FIG. 16A), CD4+(FIG. 16B), or CD8+(FIG. 16C) cells are shown.
Figure 16B:
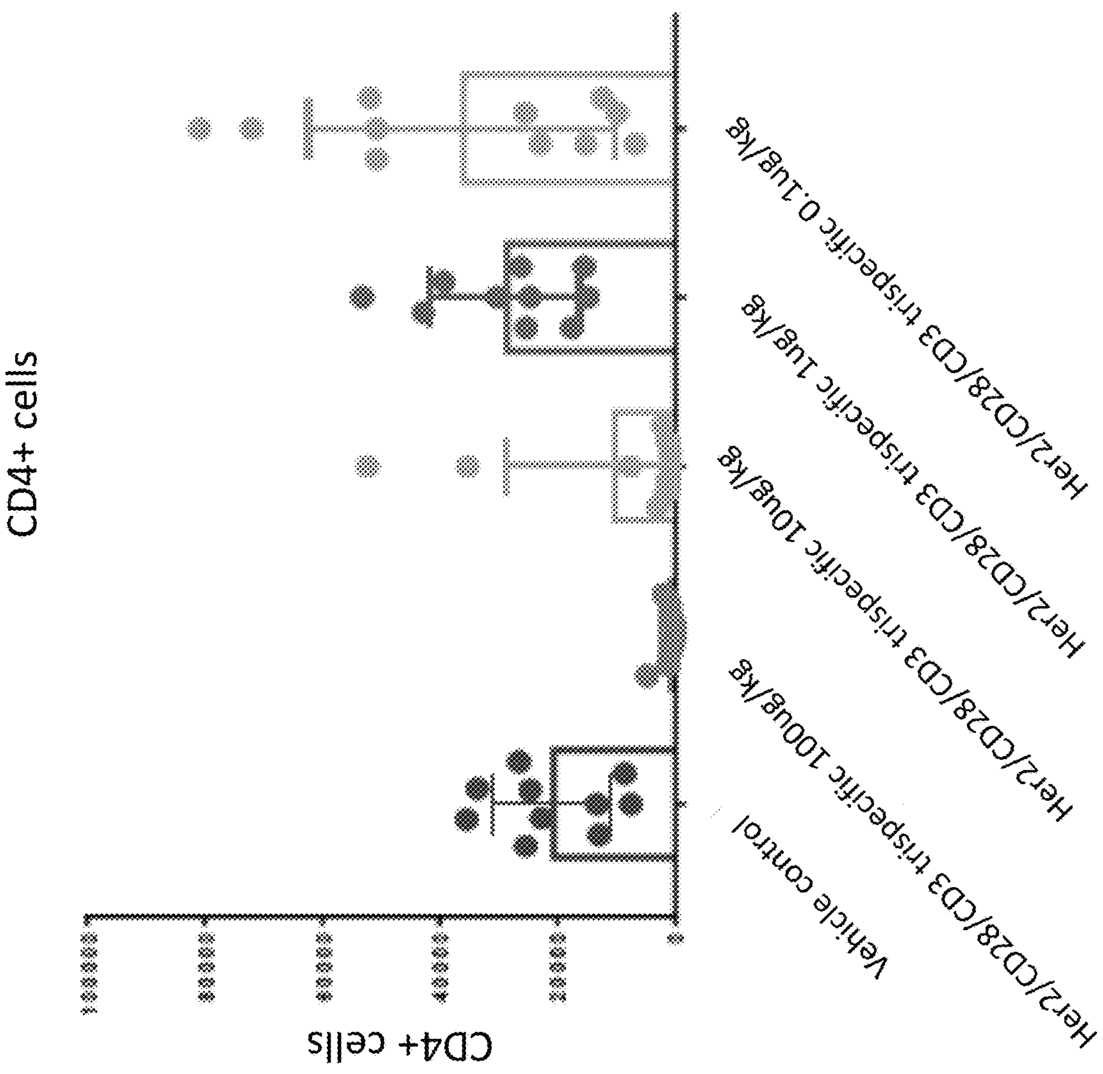
Figure 16C:
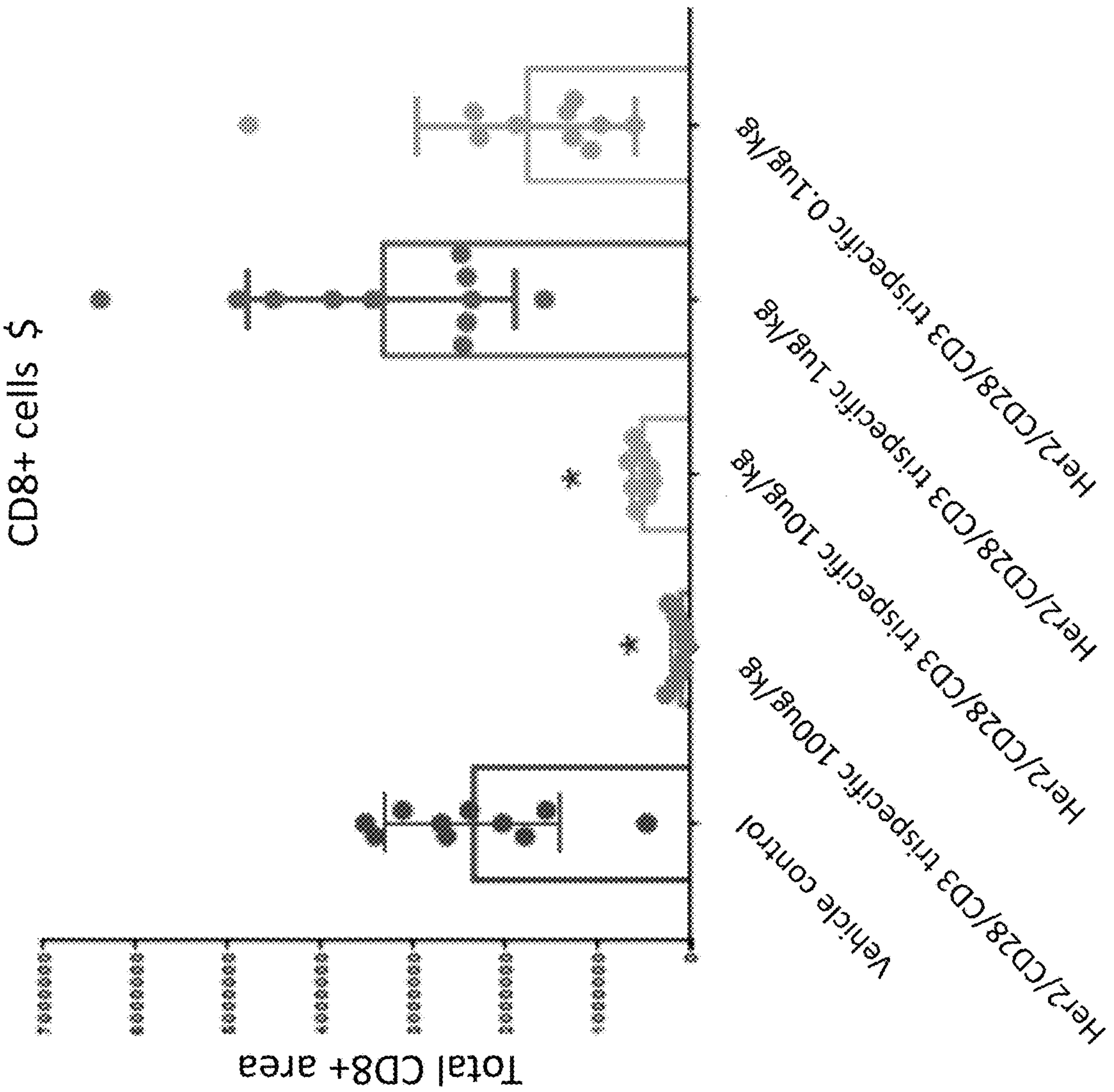

The effect of trispecific antibody treatment on tumor infiltrating lymphocytes (TILs) was also assessed by immunohistochemical (IHC) staining for human CD45, CD4, and CD8. Using H&E staining, tumors from the low dose groups (1 ug/kg or 0.1 ug/kg trispecific antibody) were generally of comparable size as the vehicle control group. As shown in FIGS. 15A-15C, human TILs were increased in the group receiving the low dose of Her2/CD28×CD3 trispecific antibody, but human TILs were sparse in the high dose group. IHC images were also examined quantitatively (FIGS. 16A-16C). These results indicated significant reductions in CD45+ and CD8+ cells in the higher trispecific antibody dose groups (100 ug/kg and 10 ug/kg).

Compared to vehicle control, tumors from the high dose trispecific antibody treatment groups (100 ug/kg or 10 ug/kg) were characterized by sparse TILs. Moderate to large numbers of CD45+, CD4+, or CD8+ human TILs were observed in the 1 ug/kg and 0.1 ug/kg trispecific antibody treatment groups. These TILs were mostly present at the tumor edges but occasionally extended deeper into the tumor core.

In conclusion, these results demonstrate that treatment of ZR-75-1 breast tumor bearing NSG mice engrafted with in vitro activated T cells using 2 intravenous doses of HER2-targeting, T cell-engaging trispecific antibody at 100 ug/kg or 10 ug/kg resulted in significant reductions in tumor volume and, concomitantly, a significant decrease in TILs. At the 1 ug/kg trispecific antibody dose, there was a marginal and inconsistent trend for increased TILs as compared to vehicle control.

Example 7: Effect of Anti-HER2 and Anti-CD3 Antigen Binding Domain Sequences in Her2/CD28×CD3 Trispecific Antibody on Cancer Cell Killing This Example describes the effect of anti-Her2 and anti-CD3 variable domain sequences on target cell killing. In this Example, a Her2/CD28×CD3 trispecific antibody ("control") with wild-type trastuzumab antigen binding domain and an anti-CD3 antigen binding domain without 32/35 QQ mutations in the VL domain (see Example 1) was compared with Her2/CD28×CD3 trispecific antibodies #1-6 from Table 1, corresponding to SEQ ID Nos: 100-103, 104-107, 286-289, 290-293, 294-297, and 298-301, respectively.

Materials and Methods

CD8+ T cells were isolated from human PBMCs from healthy donor using a magnetic bead isolation kit (Miltenyi Biotec). The T cells were used as effector cells against breast cancer cell lines expressing various levels of HER2 at 3:1 (Effector:Target) ratio. The cells were incubated with experimental or control trispecific antibody for 2 days before flow cytometry acquisition using viability dye (Invitrogen) and PKH26 target cell staining (Sigma). Mean EC50 for target cell lysis was calculated from 2-3 PBMC donors for each trispecific Ab.

Results

Figure 17A:
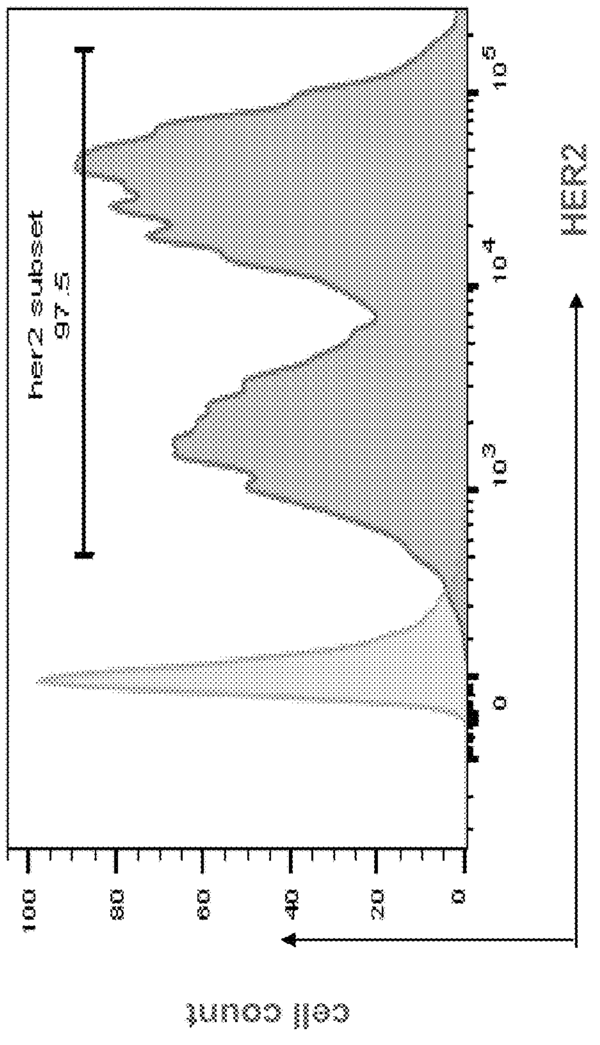
FIGS. 17A-17F show in vitro cell lysis of HER2+ breast cancer target cells in the presence of human CD8+ T cells by Her2/CD28×CD3 trispecific antibody with wild-type trastuzumab antigen binding domain and an anti-CD3 antigen binding domain without without 32/35 QQ mutations in the VL domain ("ctl") as compared to a Her2/CD28×CD3 trispecific antibodies having mutations in the anti-HER2 arm and the VL domain of the anti-CD3 arm (numbering as shown in Table 1). Cell killing activities against cell lines with varying expression of HER2 are depicted: HCC1954 for high HER2 expression (FIG. 17A), BT20 for intermediate HER2 expression (FIG. 17C), and MDA-MD-231 for low HER2 expression (FIG. 17E). Graphs depicting cell killing as a function of antibody concentration against target cells HCC1954 (FIG. 17B), BT20 (FIG. 17D), and MDA-MD-231 (FIG. 17F) are shown, comparing binding protein #2 vs. ctl or binding protein #1 and #5 vs. ctl.
Figure 17B:
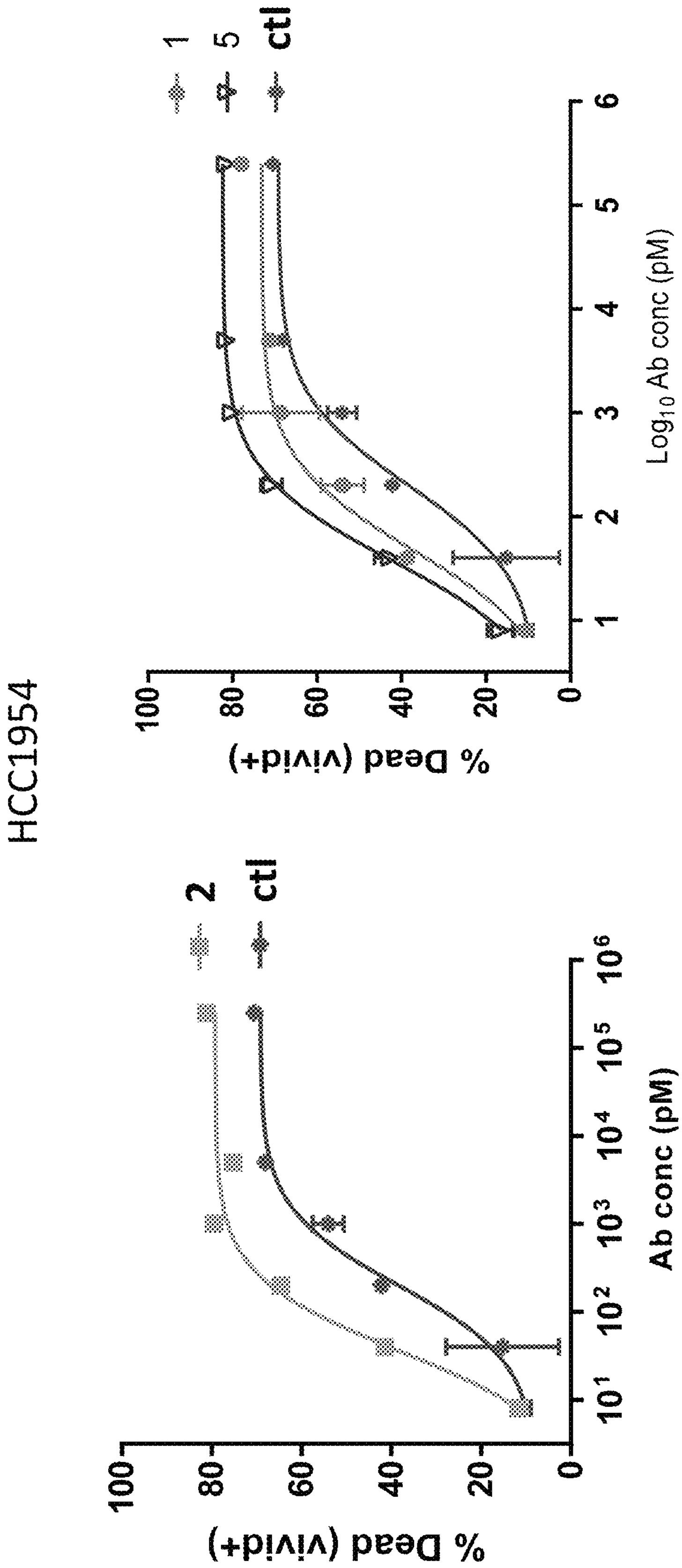
Figure 17C:
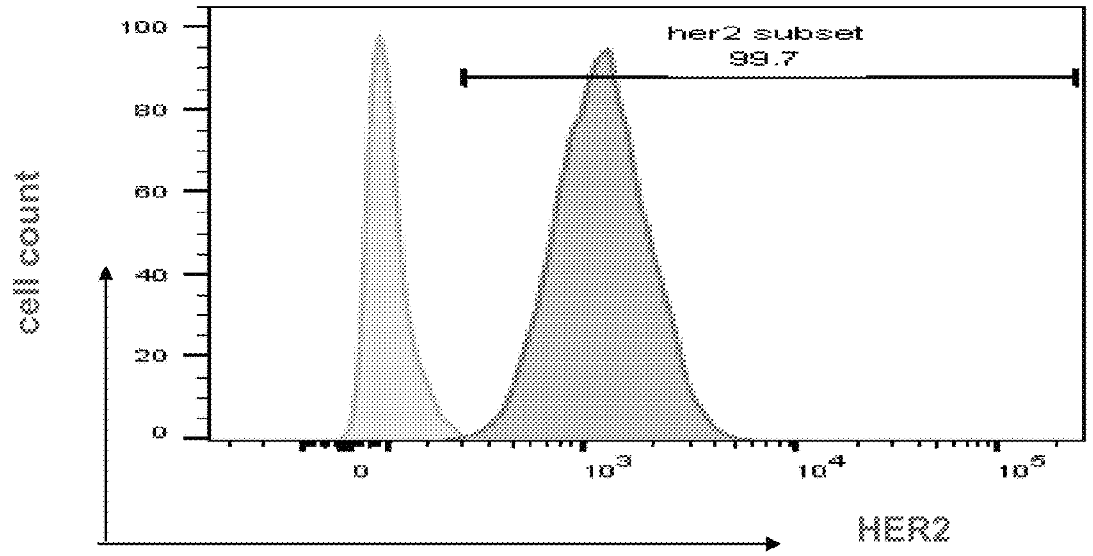
Figure 17D:
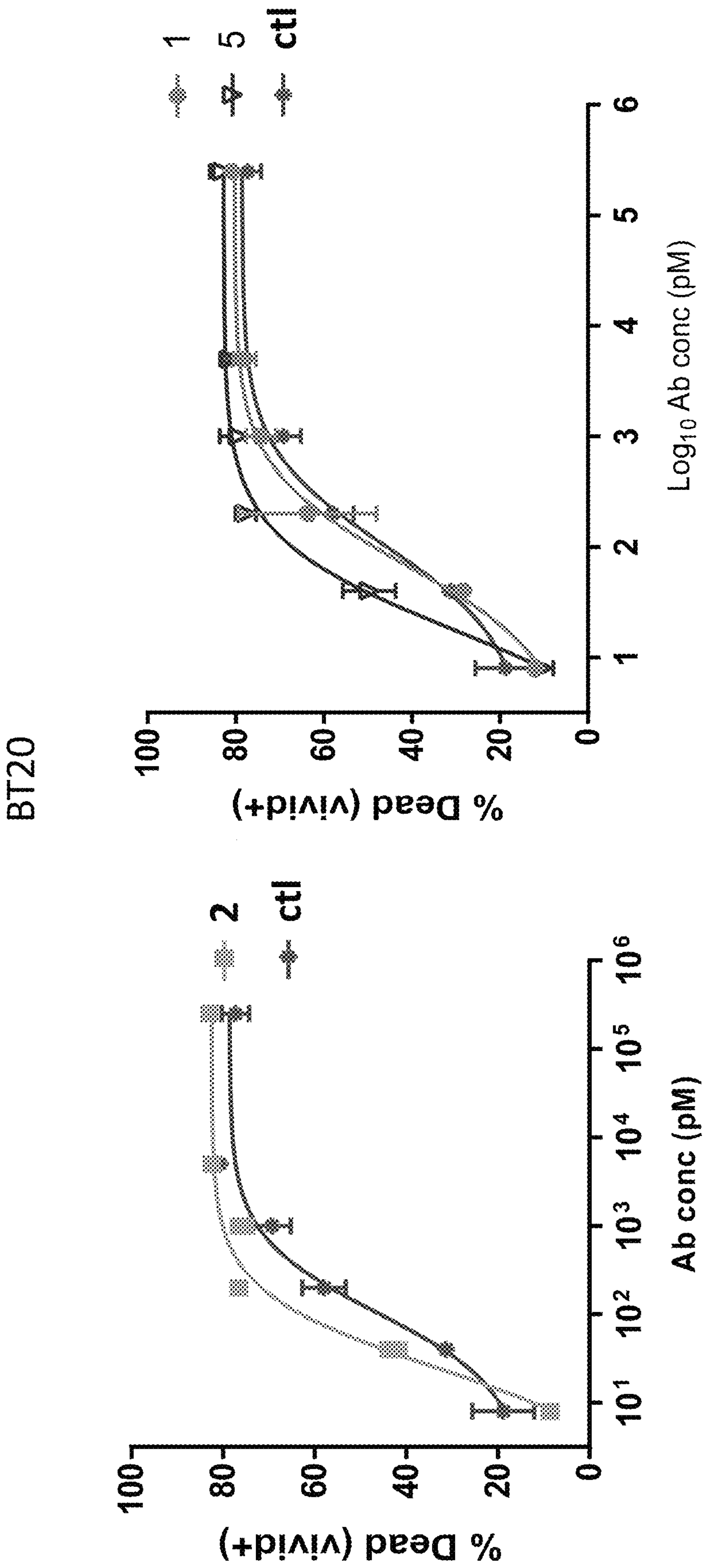
Figure 17E:
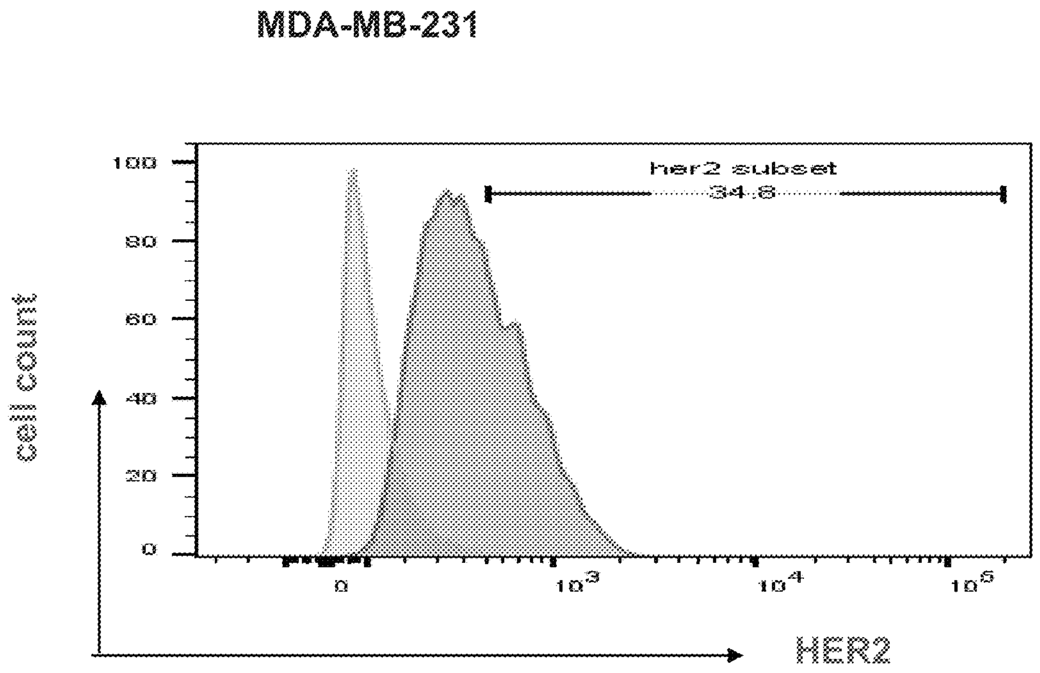
Figure 17F:
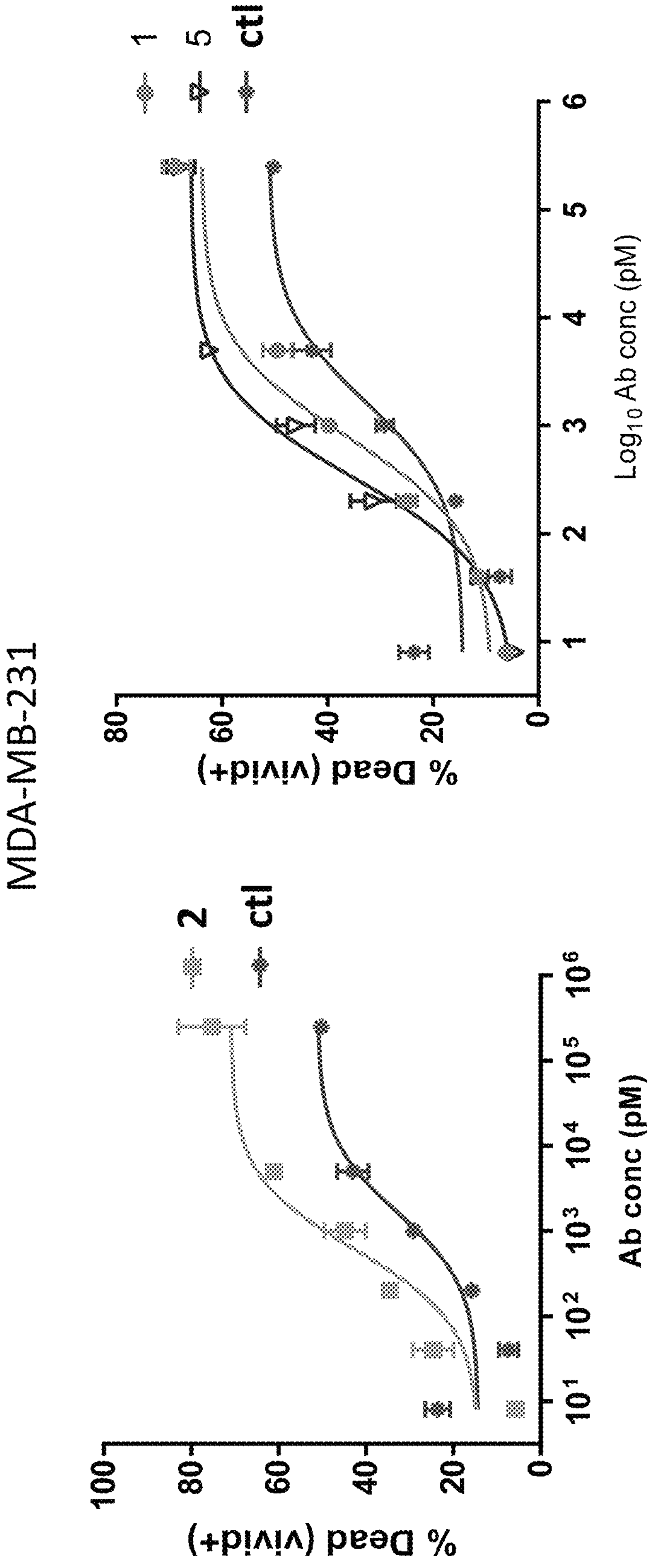

All trispecific antibodies were characterized for in vitro cell lysis of three HER2+ breast cancer target cell lines: HCC1954, BT20, and MDA-MB-231. HCC1954 breast cancer cells were found to express high levels of HER2, as assessed by flow cytometry (up to ~150,000 receptors/cell), IHC (3+), or the HercepTest HER2 expression assay (3+) (FIG. 17A). BT20 breast cancer cells were found to express intermediate levels of HER2, as assessed by flow cytometry (~60,000 receptors/cell), IHC (1+), or the HercepTest HER2 expression assay (1+) (FIG. 17C). MDA-MD-231 breast cancer cells were found to express low levels of HER2, as assessed by flow cytometry (~9,000 receptors/cell), IHC (0+), or the HercepTest HER2 expression assay (0) (FIG. 17E). Results of the cell killing assays targeting HCC1954, BT20, or MDA-MB-231 are shown in FIGS. 17B, 17D, and 17F, respectively, comparing binding protein #2 vs. control or binding proteins #1 and #5 vs. control. The results demonstrated that the Her2/CD28×CD3 trispecific antibodies having 30R/55Q/102E mutations in the anti-HER2 arm and 32/35 QQ mutations in the VL domain of the anti-CD3 arm showed improved target cell killing against all three cell lines, particularly at lower antibody concentrations.

Mean EC50 (pM) for in vitro cell killing was determined for all trispecific antibodies targeting the three breast cancer cell lines noted above (HCC1954, BT20, and MDA-MB-231) as well as the gastric cancer cell lines OE19 (high HER2 expression) and GSU (intermediate HER2 expression). Generally, the Her2/CD28×CD3 trispecific antibodies having mutations in the anti-HER2 arm and in the VL domain of the anti-CD3 arm showed a lower EC50 (and thus superior cell killing) against all three breast cancer cell lines (FIG. 18A) and both gastric cancer cell lines (FIG. 18B). These results demonstrate that, while all trispecific antibodies are able to induce cell killing of HER2+ cells, the mutated trispecific antibodies consistently displayed improved cell killing efficacy against multiple target cell types.

SEQUENCE LISTING (595 sequences)

SEQ ID NO: 1 - protein, 8 aa, Artificial Sequence
  Synthetic Construct
GFNIKDTY

SEQ ID NO: 2 - protein, 8 aa, Artificial Sequence
  Synthetic Construct
GFNIRDTY

SEQ ID NO: 3 - protein, 8 aa, Artificial Sequence
  Synthetic Construct
IYPTNGYT

SEQ ID NO: 4 - protein, 8 aa, Artificial Sequence
  Synthetic Construct
IYPTQGYT

SEQ ID NO: 5 - protein, 8 aa, Artificial Sequence
  Synthetic Construct
IYPTNAYT

SEQ ID NO: 6 - protein, 13 aa, Artificial Sequence
  Synthetic Construct
SRWGGDGFYAMDY

SEQ ID NO: 7 - protein, 13 aa, Artificial Sequence
  Synthetic Construct
SRWGGEGFYAMDY

SEQ ID NO: 8 - protein, 13 aa, Artificial Sequence
  Synthetic Construct
SRWGGSGFYAMDY

SEQ ID NO: 9 - protein, 6 aa, Artificial Sequence
  Synthetic Construct
QDVNTA

SEQ ID NO: 10 - protein, 6 aa, Artificial Sequence
  Synthetic Construct
QDVQTA

SEQ ID NO: 11 - protein, 3 aa, Artificial Sequence
  Synthetic Construct
SAS

SEQ ID NO: 12 - protein, 7 aa, Artificial Sequence
  Synthetic Construct
QQHYTTP

SEQ ID NO: 13 - protein, 8 aa, Artificial Sequence
  Synthetic Construct
GYTFTSYA

SEQ ID NO: 14 - protein, 8 aa, Artificial Sequence
  Synthetic Construct
IYPGQGGT

SEQ ID NO: 15 - protein, 13 aa, Artificial Sequence
  Synthetic Construct
ARTGGLRRAYFTY

SEQ ID NO: 16 - protein, 10 aa, Artificial Sequence
  Synthetic Construct
QSVSSYGQGF

SEQ ID NO: 17 - protein, 3 aa, Artificial Sequence
  Synthetic Construct
GAS

SEQ ID NO: 18 - protein, 9 aa, Artificial Sequence
  Synthetic Construct
QQNKEDPWT

SEQ ID NO: 19 - protein, 8 aa, Artificial Sequence
  Synthetic Construct
GYTLTEFS

SEQ ID NO: 20 - protein, 8 aa, Artificial Sequence
  Synthetic Construct
FDPEDGET

SEQ ID NO: 21 - protein, 9 aa, Artificial Sequence
  Synthetic Construct
TTGRFFDWF

SEQ ID NO: 22 - protein, 7 aa, Artificial Sequence
  Synthetic Construct
QSVISRF

SEQ ID NO: 23 - protein, 3 aa, Artificial Sequence
  Synthetic Construct
GAS

SEQ ID NO: 24 - protein, 9 aa, Artificial Sequence
  Synthetic Construct
QQDSNLPIT

SEQ ID NO: 25 - protein, 8 aa, Artificial Sequence
  Synthetic Construct
GYAFTTYL

SEQ ID NO: 26 - protein, 8 aa, Artificial Sequence
  Synthetic Construct
INPGSGST

SEQ ID NO: 27 - protein, 7 aa, Artificial Sequence
  Synthetic Construct
ARYAYGY

SEQ ID NO: 28 - protein, 6 aa, Artificial Sequence
  Synthetic Construct
QNVGTA

SEQ ID NO: 29 - protein, 3 aa, Artificial Sequence
  Synthetic Construct
SAS

SEQ ID NO: 30 - protein, 9 aa, Artificial Sequence
  Synthetic Construct
QQYSTYPFT

SEQ ID NO: 31 - protein, 8 aa, Artificial Sequence
  Synthetic Construct
GYSFTNYA

SEQ ID NO: 32 - protein, 8 aa, Artificial Sequence
  Synthetic Construct
ISPYYGDT

SEQ ID NO: 33 - protein, 13 aa, Artificial Sequence
  Synthetic Construct
ARRFEGFYYSMDY

SEQ ID NO: 34 - protein, 11 aa, Artificial Sequence
  Synthetic Construct
QSLVHSNGNTY

SEQ ID NO: 35 - protein, 3 aa, Artificial Sequence
  Synthetic Construct
KVS

SEQ ID NO: 36 - protein, 9 aa, Artificial Sequence
  Synthetic Construct
SQSTHVPLT

SEQ ID NO: 37 - protein, 8 aa, Artificial Sequence
  Synthetic Construct
GFTFSSYG

SEQ ID NO: 38 - protein, 8 aa, Artificial Sequence
  Synthetic Construct
IWYDGSNK

SEQ ID NO: 39 - protein, 15 aa, Artificial Sequence
  Synthetic Construct
ARDPGLRYFDGGMDV

SEQ ID NO: 40 - protein, 6 aa, Artificial Sequence
  Synthetic Construct
QGISSY

SEQ ID NO: 41 - protein, 3 aa, Artificial Sequence
  Synthetic Construct
AAS

SEQ ID NO: 42 - protein, 9 aa, Artificial Sequence
  Synthetic Construct
QQLNSFPYT

SEQ ID NO: 43 - protein, 8 aa, Artificial Sequence
  Synthetic Construct
GFTFSSYG

SEQ ID NO: 44 - protein, 8 aa, Artificial Sequence
  Synthetic Construct
IWYDGSNK

SEQ ID NO: 45 - protein, 10 aa, Artificial Sequence
  Synthetic Construct
ARMFRGAFDY

SEQ ID NO: 46 - protein, 6 aa, Artificial Sequence
  Synthetic Construct
QGIRND

SEQ ID NO: 47 - protein, 3 aa, Artificial Sequence
  Synthetic Construct
AAS

SEQ ID NO: 48 - protein, 9 aa, Artificial Sequence
  Synthetic Construct
LQDYIYYPT

SEQ ID NO: 49 - protein, 8 aa, Artificial Sequence
  Synthetic Construct
GYTFTSYY

SEQ ID NO: 50 - protein, 8 aa, Artificial Sequence
  Synthetic Construct
IYPGNVNT

SEQ ID NO: 51 - protein, 13 aa, Artificial Sequence
  Synthetic Construct
TRSHYGLDWNFDV

SEQ ID NO: 52 - protein, 6 aa, Artificial Sequence
  Synthetic Construct
QNIYVW

SEQ ID NO: 53 - protein, 3 aa, Artificial Sequence
  Synthetic Construct
KAS

SEQ ID NO: 54 - protein, 8 aa, Artificial Sequence
  Synthetic Construct
QQGQTYPY

SEQ ID NO: 55 - protein, 8 aa, Artificial Sequence
  Synthetic Construct
GFTFTKAW

SEQ ID NO: 56 - protein, 10 aa, Artificial Sequence
  Synthetic Construct
IKDKSNSYAT

SEQ ID NO: 57 - protein, 12 aa, Artificial Sequence
  Synthetic Construct
RGVYYALSPFDY

SEQ ID NO: 58 - protein, 11 aa, Artificial Sequence
  Synthetic Construct
QSLVHNNANTY

SEQ ID NO: 59 - protein, 11 aa, Artificial Sequence
  Synthetic Construct
QSLVHQNAQTY

SEQ ID NO: 60 - protein, 11 aa, Artificial Sequence
  Synthetic Construct
QSLVHENLQTY

SEQ ID NO: 61 - protein, 11 aa, Artificial Sequence
  Synthetic Construct
QSLVHENLFTY

SEQ ID NO: 62 - protein, 11 aa, Artificial Sequence
  Synthetic Construct
QSLVHENLRTY

SEQ ID NO: 63 - protein, 11 aa, Artificial Sequence
  Synthetic Construct
QSLVHDNAQTY

SEQ ID NO: 64 - protein, 3 aa, Artificial Sequence
  Synthetic Construct
KVS

SEQ ID NO: 65 - protein, 9 aa, Artificial Sequence
  Synthetic Construct
GQGTQYPFT

SEQ ID NO: 66 - protein, 5 aa, Artificial Sequence
  Synthetic Construct
DKTHT

SEQ ID NO: 67 - protein, 7 aa, Artificial Sequence
  Synthetic Construct
GQPKAAP

SEQ ID NO: 68 - protein, 5 aa, Artificial Sequence
  Synthetic Construct
TKGPS

SEQ ID NO: 69 - protein, 10 aa, Artificial Sequence
  Synthetic Construct
GGGGSGGGGS

SEQ ID NO: 70 - protein, 15 aa, Artificial Sequence
  Synthetic Construct
GGGGSGGGGSGGGGS

SEQ ID NO: 71 - protein, 10 aa, Artificial Sequence
  Synthetic Construct
GGSGSSGSGG

SEQ ID NO: 72 - protein, 120 aa, Artificial Sequence [sequence omitted]

SEQ ID NO: 73 - protein, 120 aa, Artificial Sequence
  Synthetic Construct
EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGEGFYAMDYWGQGTLVTVSS

SEQ ID NO: 74 - protein, 120 aa, Artificial Sequence
  Synthetic Construct
EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGSGFYAMDYWGQGTLVTVSS

SEQ ID NO: 75 - protein, 120 aa, Artificial Sequence
  Synthetic Construct
EVQLVESGGGLVQPGGSLRLSCAASGFNIRDTYIHWVRQAPGKGLEWVARIYPTNAYTRYADSVKGRFTISADTSKNTAYLQMNSLRAEDTAVYYCSRWGGSGFYAMDYWGQGTLVTVSS

SEQ ID NO: 76 - protein, 120 aa, Artificial Sequence
  Synthetic Construct
EVQLVESGGGLVQPGGSLRLSCAASGFNIRDTYIHWVRQAPGKGLEWVARIYPTNAYTRYADSVKGRFTISADTSKNTAYLQMNSLRAEDTAVYYCSRWGGEGFYAMDYWGQGTLVTVSS

SEQ ID NO: 77 - protein, 107 aa, Artificial Sequence [sequence omitted]

SEQ ID NO: 78 - protein, 107 aa, Artificial Sequence
  Synthetic Construct
DIQMTQSPSSLSASVGDRVTITCRASQDVQTAVAWYQQKPGKAPKLLIYSASFLYSGVPSRFSGSRSGTDFTLTISSLQPEDFATYYCQQHYTTPPTFGQGTKVEIK

SEQ ID NO: 79 - protein, 120 aa, Artificial Sequence
  Synthetic Construct
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSS

SEQ ID NO: 80 - protein, 111 aa, Artificial Sequence
  Synthetic Construct
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIK

SEQ ID NO: 81 - protein, 116 aa, Artificial Sequence
  Synthetic Construct
QVQLVQSGAEVKKPGASVKVSCKVSGYTLTEFSIHWVRQAPGQGLEWMGGFDPEDGETIYAQKFQGRVIMTEDTSTDTAYMEMNSLRSEDTAIYYCTTGRFFDWFWGQGTLVTVSS

SEQ ID NO: 82 - protein, 108 aa, Artificial Sequence
  Synthetic Construct
EIILTQSPAILSLSPGERATLSCRASQSVISRFLSWYQVKPGLAPRLLIYGASTRATGIPVRFSGSGSGTDFSLTISSLQPEDCAVYYCQQDSNLPITFGQGTRLEIK

SEQ ID NO: 83 - protein, 114 aa, Artificial Sequence
  Synthetic Construct
QVQLVQSGAEVKKPGASVKVSCKASGYAFTTYLVEWIRQRPGQGLEWMGVINPGSGSTNYAQKFQGRVTMTVDRSSTTAYMELSRLRSDDTAVYYCARYAYGYWGQGTLVTVSS

SEQ ID NO: 84 - protein, 107 aa, Artificial Sequence
  Synthetic Construct
DIQMTQSPSSLSASVGDRVTITCRASQNVGTAVAWYQQKPGKSPKQLIYSASNRYTGVPSRFSGSGSGTDFTLTISSLQPEDLATYYCQQYSTYPFTFGQGTKLEIK

SEQ ID NO: 85 - protein, 120 aa, Artificial Sequence
  Synthetic Construct
QVQLVQSGAEVKKPGASVKVSCKASGYSFTNYAVHWVRQAPGQGLEWMGVISPYYGDTTYAQKFQGRVTMTVDKSSSTAYMELSRLRSDDTAVYYCARRFEGFYYSMDYWGQGTLVTVSS

SEQ ID NO: 86 - protein, 112 aa, Artificial Sequence
  Synthetic Construct
DVVMTQSPLSLPVTLGQPASISCRPSQSLVHSNGNTYLNWYQQRPGQSPKLLIYKVSKRFSGVPDRFSGSGSGTDFTLKISRVEAEDVGVYYCSQSTHVPLTFGGGTKVEIK

SEQ ID NO: 87 - protein, 122 aa, Artificial Sequence
  Synthetic Construct
QVQLVESGGGVVQPGRSLRLSCAASGFTFSSYGMYWVRQAPGKGLEWVAVIWYDGSNKYYADSVKGRFTISRDNSKNTLYLQMNSLRAEDTAVYHCARDPGLRYFDGGMDVWGQGTTVTVSS

SEQ ID NO: 88 - protein, 107 aa, Artificial Sequence
  Synthetic Construct
DIQLTQSPSFLSASVGDRVTITCRASQGISSYLAWYQQKPGKAPKLLIFAASTLHSGVPSRFSGSGSGTEFTLTISSLQPEDFATYYCQQLNSFPYTFGQGTKLEIK

SEQ ID NO: 89 - protein, 117 aa, Artificial Sequence
  Synthetic Construct
QVQLVESGGGVVQPGRSLRLSCAASGFTFSSYGMHWVRQAPGKGLEWVAVIWYDGSNKYYADSVKGRFTISGDNSKNTLYLQMNSLRAEDTAVYYCARMFRGAFDYWGQGTLVTVSS

SEQ ID NO: 90 - protein, 107 aa, Artificial Sequence
  Synthetic Construct
AIQMTQSPSSLSASVGDRVTITCRASQGIRNDLGWYQQKPGKAPKLLIYAASSLQSGVPSRFSGSGSGTDFTLTISGLQPEDSATYYCLQDYIYYPTFGQGTKVEIK

SEQ ID NO: 91 - protein, 120 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSS

SEQ ID NO: 92 - protein, 107 aa, Artificial Sequence
  Synthetic Construct
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIK

SEQ ID NO: 93 - protein, 121 aa, Artificial Sequence
  Synthetic Construct
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSS

SEQ ID NO: 94 - protein, 112 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIK

SEQ ID NO: 95 - protein, 112 aa, Artificial Sequence
  Synthetic Construct
DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIK

SEQ ID NO: 96 - protein, 112 aa, Artificial Sequence
  Synthetic Construct
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIK

SEQ ID NO: 97 - protein, 112 aa, Artificial Sequence
  Synthetic Construct
DIVMTQTPLSLSVTPGQPASISCKSSQSLVHENLFTYLSWYLQKPGQSPQSLIYKVSNRFSGVPDRFSGSGSGTDFTLKISRVEAEDVGVYYCGQGTQYPFTFGSGTKVEIK

SEQ ID NO: 98 - protein, 112 aa, Artificial Sequence
  Synthetic Construct
DIVMTQTPLSLSVTPGQPASISCKSSQSLVHENLRTYLSWYLQKPGQSPQSLIYKVSNRFSGVPDRFSGSGSGTDFTLKISRVEAEDVGVYYCGQGTQYPFTFGSGTKVEIK

SEQ ID NO: 99 - protein, 112 aa, Artificial Sequence
  Synthetic Construct
DIVMTQTPLSLSVTPGQPASISCKSSQSLVHDNAQTYLSWYLQKPGQSPQSLIYKVSNRFSGVPDRFSGSGSGTDFTLKISRVEAEDVGVYYCGQGTQYPFTFGSGTKVEIK

SEQ ID NO: 100 - protein, 336 aa, Artificial Sequence
  Synthetic Construct
DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 577 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG

SEQ ID NO: 102 - protein, 446 aa, Artificial Sequence
  Synthetic Construct
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 103 - protein, 214 aa, Artificial Sequence
  Synthetic Construct
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 336 aa, Artificial Sequence; identical to SEQ ID NO: 100
  Synthetic Construct

SEQ ID NO: 105 - protein, 577 aa, Artificial Sequence; identical to SEQ ID NO: 101
  Synthetic Construct

SEQ ID NO: 106 - protein, 446 aa, Artificial Sequence
  Synthetic Construct
EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGEGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 107 - protein, 214 aa, Artificial Sequence; identical to SEQ ID NO: 103
  Synthetic Construct

SEQ ID NO: 108 - protein, 336 aa, Artificial Sequence
  Synthetic Construct
DIVMTQTPLSLSVTPGQPASISCKSSQSLVHDNAQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 577 aa, Artificial Sequence; identical to SEQ ID NO: 101
  Synthetic Construct

SEQ ID NO: 110 - protein, 446 aa, Artificial Sequence; identical to SEQ ID NO: 106
  Synthetic Construct

SEQ ID NO: 111 - protein, 214 aa, Artificial Sequence; identical to SEQ ID NO: 103
  Synthetic Construct

SEQ ID NO: 112 - protein, 338 aa, Artificial Sequence
  Synthetic Construct
DIVMTQTPLSLSVTPGQPASISCKSSQSLVHQNAQTYLSWYLQKPGQSPQSLIYKVSNRFSGVPDRFSGSGSGTDFTLKISRVEAEDVGVYYCGQGTQYPFTFGSGTKVEIKGQPKAAPDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 570 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG

SEQ ID NO: 114 - protein, 446 aa, Artificial Sequence; identical to SEQ ID NO: 106
  Synthetic Construct

SEQ ID NO: 115 - protein, 214 aa, Artificial Sequence; identical to SEQ ID NO: 103
  Synthetic Construct

SEQ ID NO: 116 - protein, 338 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGQPKAAPDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 117 - protein, 570 aa, Artificial Sequence; identical to SEQ ID NO: 113
  Synthetic Construct

SEQ ID NO: 118 - protein, 446 aa, Artificial Sequence
  Synthetic Construct
EVQLVESGGGLVQPGGSLRLSCAASGFNIRDTYIHWVRQAPGKGLEWVARIYPTQGYTRYADSVKGRFTISADTSKNTAYLQMNSLRAEDTAVYYCSRWGGSGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 119 - protein, 214 aa, Artificial Sequence; identical to SEQ ID NO: 103
  Synthetic Construct

SEQ ID NO: 120 - protein, 338 aa, Artificial Sequence; identical to SEQ ID NO: 116
  Synthetic Construct

SEQ ID NO: 121 - protein, 570 aa, Artificial Sequence; identical to SEQ ID NO: 113
  Synthetic Construct

SEQ ID NO: 122 - protein, 446 aa, Artificial Sequence
  Synthetic Construct
EVQLVESGGGLVQPGGSLRLSCAASGFNIRDTYIHWVRQAPGKGLEWVARIYPTNAYTRYADSVKGRFTISADTSKNTAYLQMNSLRAEDTAVYYCSRWGGSGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 123 - protein, 214 aa, Artificial Sequence; identical to SEQ ID NO: 103
  Synthetic Construct

SEQ ID NO: 124 - protein, 338 aa, Artificial Sequence; identical to SEQ ID NO: 116
  Synthetic Construct

SEQ ID NO: 125 - protein, 570 aa, Artificial Sequence; identical to SEQ ID NO: 113
  Synthetic Construct

SEQ ID NO: 126 - protein, 446 aa, Artificial Sequence
  Synthetic Construct
EVQLVESGGGLVQPGGSLRLSCAASGFNIRDTYIHWVRQAPGKGLEWVARIYPTNAYTRYADSVKGRFTISADTSKNTAYLQMNSLRAEDTAVYYCSRWGGEGFYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 127 - protein, 214 aa, Artificial Sequence; identical to SEQ ID NO: 103
  Synthetic Construct

SEQ ID NO: 128 - protein, 338 aa, Artificial Sequence; identical to SEQ ID NO: 112
  Synthetic Construct

SEQ ID NO: 129 - protein, 570 aa, Artificial Sequence; identical to SEQ ID NO: 113
  Synthetic Construct

SEQ ID NO: 130 - protein, 446 aa, Artificial Sequence; identical to SEQ ID NO: 102
  Synthetic Construct

SEQ ID NO: 131 - protein, 214 aa, Artificial Sequence; identical to SEQ ID NO: 103
  Synthetic Construct

SEQ ID NO: 132 - protein, 336 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 577 aa, Artificial Sequence; identical to SEQ ID NO: 101
  Synthetic Construct

SEQ ID NO: 134 - protein, 446 aa, Artificial Sequence; identical to SEQ ID NO: 102
  Synthetic Construct

SEQ ID NO: 135 - protein, 214 aa, Artificial Sequence; identical to SEQ ID NO: 103
  Synthetic Construct

SEQ ID NO: 136 - protein, 336 aa, Artificial Sequence
  Synthetic Construct
DIVMTQTPLSLSVTPGQPASISCKSSQSLVHENLRTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 577 aa, Artificial Sequence; identical to SEQ ID NO: 101
  Synthetic Construct

SEQ ID NO: 138 - protein, 446 aa, Artificial Sequence; identical to SEQ ID NO: 102
  Synthetic Construct

SEQ ID NO: 139 - protein, 214 aa, Artificial Sequence; identical to SEQ ID NO: 103
  Synthetic Construct

SEQ ID NO: 140 - protein, 336 aa, Artificial Sequence
  Synthetic Construct
DIVMTQTPLSLSVTPGQPASISCKSSQSLVHENLQTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 577 aa, Artificial Sequence; identical to SEQ ID NO: 101
  Synthetic Construct

SEQ ID NO: 142 - protein, 446 aa, Artificial Sequence; identical to SEQ ID NO: 102
  Synthetic Construct

SEQ ID NO: 143 - protein, 214 aa, Artificial Sequence; identical to SEQ ID NO: 103
  Synthetic Construct

SEQ ID NO: 144 - protein, 336 aa, Artificial Sequence
  Synthetic Construct
DIVMTQTPLSLSVTPGQPASISCKSSQSLVHENLFTYLSWYLQKPGQSPQSLIYKVSNRFSGVPDRFSGSGSGTDFTLKISRVEAEDVGVYYCGQGTQYPFTFGSGTKVEIKDKTHTDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - protein, 577 aa, Artificial Sequence; identical to SEQ ID NO: 101
  Synthetic Construct

SEQ ID NO: 146 - protein, 446 aa, Artificial Sequence; identical to SEQ ID NO: 102
  Synthetic Construct

SEQ ID NO: 147 - protein, 214 aa, Artificial Sequence; identical to SEQ ID NO: 103
  Synthetic Construct

SEQ ID NO: 148 - protein, 338 aa, Artificial Sequence; identical to SEQ ID NO: 116
  Synthetic Construct

SEQ ID NO: 149 - protein, 570 aa, Artificial Sequence; identical to SEQ ID NO: 113
  Synthetic Construct

SEQ ID NO: 150 - protein, 446 aa, Artificial Sequence; identical to SEQ ID NO: 102
  Synthetic Construct

SEQ ID NO: 151 - protein, 214 aa, Artificial Sequence; identical to SEQ ID NO: 103
  Synthetic Construct

SEQ ID NO: 152 - protein, 336 aa, Artificial Sequence; identical to SEQ ID NO: 136
  Synthetic Construct

SEQ ID NO: 153 - protein, 577 aa, Artificial Sequence; identical to SEQ ID NO: 101
  Synthetic Construct

SEQ ID NO: 154 - protein, 446 aa, Artificial Sequence; identical to SEQ ID NO: 106
  Synthetic Construct

SEQ ID NO: 155 - protein, 214 aa, Artificial Sequence; identical to SEQ ID NO: 103
  Synthetic Construct

SEQ ID NO: 156 - protein, 336 aa, Artificial Sequence; identical to SEQ ID NO: 140
  Synthetic Construct

SEQ ID NO: 157 - protein, 577 aa, Artificial Sequence; identical to SEQ ID NO: 101
  Synthetic Construct

SEQ ID NO: 158 - protein, 446 aa, Artificial Sequence
  Synthetic Construct
QVQLVQSGAEVVKPGASVKVSCKASGYTFTSYAMHWVKEAPGQRLEWIGYIYPGQGGTNYNQKFQGRATLTADTSASTAYMELSSLRSEDTAVYFCARTGGLRRAYFTYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 159 - protein, 218 aa, Artificial Sequence
  Synthetic Construct
DIVLTQSPATLSLSPGERATISCRASQSVSSYGQGFMHWYQQKPGQPPRLLIYGASSRATGIPARFSGSGSGTDFTLTISPLEPEDFAVYYCQQNKEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 336 aa, Artificial Sequence; identical to SEQ ID NO: 140
  Synthetic Construct

SEQ ID NO: 161 - protein, 577 aa, Artificial Sequence; identical to SEQ ID NO: 101
  Synthetic Construct

SEQ ID NO: 162 - protein, 442 aa, Artificial Sequence
  Synthetic Construct
QVQLVQSGAEVKKPGASVKVSCKVSGYTLTEFSIHWVRQAPGQGLEWMGGFDPEDGETIYAQKFQGRVIMTEDTSTDTAYMEMNSLRSEDTAIYYCTTGRFFDWFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 163 - protein, 215 aa, Artificial Sequence
  Synthetic Construct
EIILTQSPAILSLSPGERATLSCRASQSVISRFLSWYQVKPGLAPRLLIYGASTRATGIPVRFSGSGSGTDFSLTISSLQPEDCAVYYCQQDSNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 336 aa, Artificial Sequence; identical to SEQ ID NO: 140
  Synthetic Construct

SEQ ID NO: 165 - protein, 577 aa, Artificial Sequence; identical to SEQ ID NO: 101
  Synthetic Construct

SEQ ID NO: 166 - protein, 440 aa, Artificial Sequence
  Synthetic Construct
QVQLQQSGPELVRPGTSVKVSCKASGYAFTTYLVEWIKQRPGQGLEWIGVINPGSGSTNYNEKFKGKATLTVDRSSTTAYMHLSGLTSDDSAVYFCARYAYGYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 167 - protein, 214 aa, Artificial Sequence
  Synthetic Construct
DIVMTQSQKFMSASVGDRVSITCKASQNVGTAVAWYQQQPGHSPKQLIYSASNRYTGVPDRFTGSGAGTDFTLTISNIQSEDLADYFCQQYSTYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 336 aa, Artificial Sequence; identical to SEQ ID NO: 140
  Synthetic Construct

SEQ ID NO: 169 - protein, 577 aa, Artificial Sequence; identical to SEQ ID NO: 101
  Synthetic Construct

SEQ ID NO: 170 - protein, 446 aa, Artificial Sequence
  Synthetic Construct
QVQLLQSGAELVRPGVSVKISCTGSGYSFTNYAVHWVKQSHVKSLEWIGVISPYYGDTTYNQKFTGKATMTVDKSSSTAYMELARLTSEDSAIYFCARRFEGFYYSMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 171 - protein, 219 aa, Artificial Sequence
  Synthetic Construct
DVVMIQTPLSLPVSLGDQASISCRPSQSLVHSNGNTYLNWYLQRPGQSPKLLIYKVSKRFSGVPDRFSGSGSGTDFTLKISRVEAEDLGVYLCSQSTHVPLTFGSGTQLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 336 aa, Artificial Sequence; identical to SEQ ID NO: 140
  Synthetic Construct

SEQ ID NO: 173 - protein, 577 aa, Artificial Sequence; identical to SEQ ID NO: 101
  Synthetic Construct

SEQ ID NO: 174 - protein, 448 aa, Artificial Sequence
  Synthetic Construct
QVQLVESGGGVVQPGRSLRLSCAASGFTFSSYGMYWVRQAPGKGLEWVAVIWYDGSNKYYADSVKGRFTISRDNSKNTLYLQMNSLRAEDTAVYHCARDPGLRYFDGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 175 - protein, 214 aa, Artificial Sequence
  Synthetic Construct
DIQLTQSPSFLSASVGDRVTITCRASQGISSYLAWYQQKPGKAPKLLIFAASTLHSGVPSRFSGSGSGTEFTLTISSLQPEDFATYYCQQLNSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 336 aa, Artificial Sequence; identical to SEQ ID NO: 140
  Synthetic Construct

SEQ ID NO: 177 - protein, 577 aa, Artificial Sequence; identical to SEQ ID NO: 101
  Synthetic Construct

SEQ ID NO: 178 - protein, 443 aa, Artificial Sequence
  Synthetic Construct
QVQLVESGGGVVQPGRSLRLSCAASGFTFSSYGMHWVRQAPGKGLEWVAVIWYDGSNKYYADSVKGRFTISGDNSKNTLYLQMNSLRAEDTAVYYCARMFRGAFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 179 - protein, 214 aa, Artificial Sequence
  Synthetic Construct
AIQMTQSPSSLSASVGDRVTITCRASQGIRNDLGWYQQKPGKAPKLLIYAASSLQSGVPSRFSGSGSGTDFTLTISGLQPEDSATYYCLQDYIYYPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 180 - protein, 11 aa, Artificial Sequence
  Synthetic Construct
  VARIANT 6: Xaa = Glu or Gln
  VARIANT 8: Xaa = Ala or Leu
  VARIANT 9: Xaa = Gln, Arg, or Phe
QSLVHXNXXTY

SEQ ID NO: 181 - protein, 336 aa, Artificial Sequence; identical to SEQ ID NO: 140
  Synthetic Construct

SEQ ID NO: 182 - protein, 577 aa, Artificial Sequence; identical to SEQ ID NO: 101
  Synthetic Construct

SEQ ID NO: 183 - protein, 440 aa, Artificial Sequence
  Synthetic Construct
QVQLVQSGAEVKKPGASVKVSCKASGYAFTTYLVEWIRQRPGQGLEWMGVINPGSGSTNYAQKFQGRVTMTVDRSSTTAYMELSRLRSDDTAVYYCARYAYGYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 184 - protein, 214 aa, Artificial Sequence
  Synthetic Construct
DIQMTQSPSSLSASVGDRVTITCRASQNVGTAVAWYQQKPGKSPKQLIYSASNRYTGVPSRFSGSGSGTDFTLTISSLQPEDLATYYCQQYSTYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 185 - protein, 336 aa, Artificial Sequence; identical to SEQ ID NO: 140
  Synthetic Construct

SEQ ID NO: 186 - protein, 577 aa, Artificial Sequence; identical to SEQ ID NO: 101
  Synthetic Construct

SEQ ID NO: 187 - protein, 446 aa, Artificial Sequence
  Synthetic Construct
QVQLVQSGAEVKKPGASVKVSCKASGYSFTNYAVHWVRQAPGQGLEWMGVISPYYGDTTYAQKFQGRVTMTVDKSSSTAYMELSRLRSDDTAVYYCARRFEGFYYSMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 188 - protein, 219 aa, Artificial Sequence
  Synthetic Construct
DVVMTQSPLSLPVTLGQPASISCRPSQSLVHSNGNTYLNWYQQRPGQSPKLLIYKVSKRFSGVPDRFSGSGSGTDFTLKISRVEAEDVGVYYCSQSTHVPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - DNA, 1008 bp, Artificial Sequence
  Synthetic Construct
gacatcgtgatgacccagacccccctgagcctgagcgtgacacctggacagcctgccagcatcagctgcaagagcagccagagcctggtgcaccagaacgcccagacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 190 - DNA, 1731 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcgacaaaacccatacccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtgataagacccacaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggc

SEQ ID NO: 191 - DNA, 1338 bp, Artificial Sequence
  Synthetic Construct
gaagtgcagctggtggaatctggcggcggactggtgcagcctggcggatctctgagactgagctgtgccgccagcggcttcaacatcaaggacacctacatccactgggtgcgccaggcccctggcaagggactggaatgggtggccagaatctaccccaccaacggctacaccagatacgccgacagcgtgaagggccggttcaccatcagcgccgacaccagcaagaacaccgcctacctgcagatgaacagcctgcgggccgaggacaccgccgtgtactactgtagtagatggggaggcgacggcttctacgccatggactattggggccagggcaccctcgtgaccgtgtctagtgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 192 - DNA, 642 bp, Artificial Sequence
  Synthetic Construct
gacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctgtacagcggcgtgcccagcagattcagcggaagcagaagcggcaccgacttcaccctgaccatcagctccctgcagcccgaggacttcgccacctactactgccagcagcactacaccaccccccccacatttggccagggcaccaaggtggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 193 - DNA, 1008 bp, Artificial Sequence; identical to SEQ ID NO: 189
  Synthetic Construct

SEQ ID NO: 194 - DNA, 1731 bp, Artificial Sequence; identical to SEQ ID NO: 190
  Synthetic Construct

SEQ ID NO: 195 - DNA, 1338 bp, Artificial Sequence
  Synthetic Construct
gaagtgcagctggtggaatctggcggcggactggtgcagcctggcggatctctgagactgagctgtgccgccagcggcttcaacatccgggacacctacatccactgggtgcgccaggcccctggcaagggactggaatgggtggccagaatctaccccacccagggctacaccagatacgccgacagcgtgaagggccggttcaccatcagcgccgacaccagcaagaacaccgcctacctgcagatgaacagcctgcgggccgaggacaccgccgtgtactactgtagtagatggggaggcgaaggcttctacgccatggactattggggccagggcaccctcgtgaccgtgtctagtgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 196 - DNA, 1731 bp, Artificial Sequence; identical to SEQ ID NO: 190
  Synthetic Construct

SEQ ID NO: 197 - DNA, 1008 bp, Artificial Sequence
  Synthetic Construct
gacatcgtgatgacccagacccccctgagcctgagcgtgacacctggacagcctgccagcatcagctgcaagagcagccagagcctggtgcacgacaacgcccagacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 198 - DNA, 1731 bp, Artificial Sequence; identical to SEQ ID NO: 190
  Synthetic Construct

SEQ ID NO: 199 - DNA, 1338 bp, Artificial Sequence; identical to SEQ ID NO: 195
  Synthetic Construct

SEQ ID NO: 200 - DNA, 1731 bp, Artificial Sequence; identical to SEQ ID NO: 190
  Synthetic Construct

SEQ ID NO: 201 - DNA, 1014 bp, Artificial Sequence
  Synthetic Construct
gacatcgtgatgacccagacccccctgagcctgagcgtgacacctggacagcctgccagcatcagctgcaagagcagccagagcctggtgcaccagaacgcccagacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagggccagcccaaggccgcccccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 202 - DNA, 1710 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcagccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggc

SEQ ID NO: 203 - DNA, 1338 bp, Artificial Sequence; identical to SEQ ID NO: 195
  Synthetic Construct

SEQ ID NO: 204 - DNA, 1731 bp, Artificial Sequence; identical to SEQ ID NO: 190
  Synthetic Construct

SEQ ID NO: 205 - DNA, 1014 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagggccagcccaaggccgcccccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 206 - DNA, 1710 bp, Artificial Sequence; identical to SEQ ID NO: 202
  Synthetic Construct

SEQ ID NO: 207 - DNA, 1338 bp, Artificial Sequence
  Synthetic Construct
gaagtgcagctggtggaatctggcggcggactggtgcagcctggcggatctctgagactgagctgtgccgccagcggcttcaacatccgggacacctacatccactgggtgcgccaggcccctggcaagggactggaatgggtggccagaatctaccccacccagggctacaccagatacgccgacagcgtgaagggccggttcaccatcagcgccgacaccagcaagaacaccgcctacctgcagatgaacagcctgcgggccgaggacaccgccgtgtactactgtagtagatggggaggctccggcttctacgccatggactattggggccagggcaccctcgtgaccgtgtctagtgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 208 - DNA, 1731 bp, Artificial Sequence; identical to SEQ ID NO: 190
  Synthetic Construct

SEQ ID NO: 209 - DNA, 1014 bp, Artificial Sequence; identical to SEQ ID NO: 205
  Synthetic Construct

SEQ ID NO: 210 - DNA, 1710 bp, Artificial Sequence; identical to SEQ ID NO: 202
  Synthetic Construct

SEQ ID NO: 211 - DNA, 1338 bp, Artificial Sequence
  Synthetic Construct
gaagtgcagctggtggaatctggcggcggactggtgcagcctggcggatctctgagactgagctgtgccgccagcggcttcaacatccgggacacctacatccactgggtgcgccaggcccctggcaagggactggaatgggtggccagaatctaccccaccaacgcctacaccagatacgccgacagcgtgaagggccggttcaccatcagcgccgacaccagcaagaacaccgcctacctgcagatgaacagcctgcgggccgaggacaccgccgtgtactactgtagtagatggggaggctccggcttctacgccatggactattggggccagggcaccctcgtgaccgtgtctagtgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 212 - DNA, 1731 bp, Artificial Sequence; identical to SEQ ID NO: 190
  Synthetic Construct

SEQ ID NO: 213 - DNA, 1014 bp, Artificial Sequence; identical to SEQ ID NO: 205
  Synthetic Construct

SEQ ID NO: 214 - DNA, 1710 bp, Artificial Sequence; identical to SEQ ID NO: 202
  Synthetic Construct

SEQ ID NO: 215 - DNA, 1338 bp, Artificial Sequence
  Synthetic Construct
gaagtgcagctggtggaatctggcggcggactggtgcagcctggcggatctctgagactgagctgtgccgccagcggcttcaacatccgggacacctacatccactgggtgcgccaggcccctggcaagggactggaatgggtggccagaatctaccccaccaacgcctacaccagatacgccgacagcgtgaagggccggttcaccatcagcgccgacaccagcaagaacaccgcctacctgcagatgaacagcctgcgggccgaggacaccgccgtgtactactgtagtagatggggaggcgaaggcttctacgccatggactattggggccagggcaccctcgtgaccgtgtctagtgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 216 - DNA, 1731 bp, Artificial Sequence; identical to SEQ ID NO: 190
  Synthetic Construct

SEQ ID NO: 217 - DNA, 1014 bp, Artificial Sequence; identical to SEQ ID NO: 201
  Synthetic Construct

SEQ ID NO: 218 - DNA, 1710 bp, Artificial Sequence; identical to SEQ ID NO: 202
  Synthetic Construct

SEQ ID NO: 219 - DNA, 1338 bp, Artificial Sequence; identical to SEQ ID NO: 191
  Synthetic Construct

SEQ ID NO: 220 - DNA, 642 bp, Artificial Sequence; identical to SEQ ID NO: 192
  Synthetic Construct

SEQ ID NO: 221 - DNA, 1008 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 222 - DNA, 1731 bp, Artificial Sequence; identical to SEQ ID NO: 190
  Synthetic Construct

SEQ ID NO: 223 - DNA, 1338 bp, Artificial Sequence; identical to SEQ ID NO: 191
  Synthetic Construct

SEQ ID NO: 224 - DNA, 642 bp, Artificial Sequence; identical to SEQ ID NO: 192
  Synthetic Construct

SEQ ID NO: 225 - DNA, 1008 bp, Artificial Sequence
  Synthetic Construct
gacatcgtgatgacccagacccccctgagcctgagcgtgacacctggacagcctgccagcatcagctgcaagagcagccagagcctggtgcacgagaacctgcgtacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 226 - DNA, 1731 bp, Artificial Sequence; identical to SEQ ID NO: 190
  Synthetic Construct

SEQ ID NO: 227 - DNA, 1338 bp, Artificial Sequence; identical to SEQ ID NO: 191
  Synthetic Construct

SEQ ID NO: 228 - DNA, 642 bp, Artificial Sequence; identical to SEQ ID NO: 192
  Synthetic Construct

SEQ ID NO: 229 - DNA, 1008 bp, Artificial Sequence
  Synthetic Construct
gacatcgtgatgacccagacccccctgagcctgagcgtgacacctggacagcctgccagcatcagctgcaagagcagccagagcctggtgcacgagaacctgcagacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 230 - DNA, 1731 bp, Artificial Sequence; identical to SEQ ID NO: 190
  Synthetic Construct

SEQ ID NO: 231 - DNA, 1338 bp, Artificial Sequence; identical to SEQ ID NO: 191
  Synthetic Construct

SEQ ID NO: 232 - DNA, 642 bp, Artificial Sequence; identical to SEQ ID NO: 192
  Synthetic Construct

SEQ ID NO: 233 - DNA, 1008 bp, Artificial Sequence
  Synthetic Construct
gacatcgtgatgacccagacccccctgagcctgagcgtgacacctggacagcctgccagcatcagctgcaagagcagccagagcctggtgcacgagaacctgttcacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 234 - DNA, 1731 bp, Artificial Sequence; identical to SEQ ID NO: 190
  Synthetic Construct

SEQ ID NO: 235 - DNA, 1338 bp, Artificial Sequence; identical to SEQ ID NO: 191
  Synthetic Construct

SEQ ID NO: 236 - DNA, 642 bp, Artificial Sequence; identical to SEQ ID NO: 192
  Synthetic Construct

SEQ ID NO: 237 - DNA, 1014 bp, Artificial Sequence; identical to SEQ ID NO: 205
  Synthetic Construct

SEQ ID NO: 238 - DNA, 1710 bp, Artificial Sequence; identical to SEQ ID NO: 202
  Synthetic Construct

SEQ ID NO: 239 - DNA, 1338 bp, Artificial Sequence; identical to SEQ ID NO: 191
  Synthetic Construct

SEQ ID NO: 240 - DNA, 642 bp, Artificial Sequence; identical to SEQ ID NO: 192
  Synthetic Construct

SEQ ID NO: 241 - DNA, 1008 bp, Artificial Sequence; identical to SEQ ID NO: 225
  Synthetic Construct

SEQ ID NO: 242 - DNA, 1731 bp, Artificial Sequence; identical to SEQ ID NO: 190
  Synthetic Construct

SEQ ID NO: 243 - DNA, 1338 bp, Artificial Sequence; identical to SEQ ID NO: 195
  Synthetic Construct

SEQ ID NO: 244 - DNA, 642 bp, Artificial Sequence; identical to SEQ ID NO: 192
  Synthetic Construct

SEQ ID NO: 245 - DNA, 1008 bp, Artificial Sequence; identical to SEQ ID NO: 233
  Synthetic Construct

SEQ ID NO: 246 - DNA, 1731 bp, Artificial Sequence; identical to SEQ ID NO: 190
  Synthetic Construct

SEQ ID NO: 247 - DNA, 1338 bp, Artificial Sequence
  Synthetic Construct
caggtgcagctggtgcagtctggcgccgaagtcgtgaaacctggcgcctccgtgaaggtgtcctgcaaggccagcggctacacctttaccagctacgccatgcactgggtcaaagaggcccctggccagagactggaatggatcggctacatctaccccggccagggcggcaccaactacaaccagaagttccagggcagagccaccctgaccgccgatacaagcgccagcaccgcctacatggaactgagcagcctgcggagcgaggataccgccgtgtacttctgtgccagaacaggcggcctgaggcgggcctactttacctattggggccagggcaccctcgtgaccgtgtctagcgctagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 248 - DNA, 654 bp, Artificial Sequence
  Synthetic Construct
gacatcgtgctgacacagagccctgccaccctgtctctgagccctggcgagagagccaccatcagctgtagagccagccagagcgtgtccagctacggccagggcttcatgcactggtatcagcagaagcccggccagccccccagactgctgatctatggcgccagcagcagagccacaggcatccccgccagattttctggctctggcagcggcaccgacttcaccctgacaatcagccccctggaacccgaggacttcgccgtgtactactgccagcagaacaaagaggacccctggaccttcggcggaggcaccaagctggaaatcaagcgtacggtggccgctcccagcgtgttcatcttcccacctagcgacgagcagctgaagtccggcacagcctctgtcgtgtgcctgctgaacaacttctacccccgcgaggccaaggtgcagtggaaggtggacaatgccctgcagagcggcaacagccaggaaagcgtgaccgagcaggacagcaaggactccacctacagcctgagcagcaccctgaccctgtccaaggccgattacgagaagcacaaggtgtacgcctgcgaagtgacccaccagggcctgtctagccccgtgaccaagagcttcaaccggggcgagtgc

SEQ ID NO: 249 - DNA, 1008 bp, Artificial Sequence; identical to SEQ ID NO: 229
  Synthetic Construct

SEQ ID NO: 250 - DNA, 1731 bp, Artificial Sequence; identical to SEQ ID NO: 190
  Synthetic Construct

SEQ ID NO: 251 - DNA, 1326 bp, Artificial Sequence
  Synthetic Construct
caggttcagctggttcagtctggcgccgaagtgaagaaacctggcgcctctgtgaaggtgtcctgcaaggtgtccggctacaccctgaccgagttcagcatccactgggtccgacaggctccaggacaaggcttggaatggatgggcggcttcgatcccgaggacggcgaaacaatctacgcccagaaattccagggccgcgtgatcatgaccgaggacacctctaccgacaccgcctacatggaaatgaacagcctgcggagcgaggataccgccatctactactgtaccaccggcagattcttcgactggttctggggccagggcaccctggttacagtctcttctgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 252 - DNA, 645 bp, Artificial Sequence
  Synthetic Construct
gagatcatcctgacacagagccccgccatcctgtcactgtctccaggcgaaagagccacactgagctgtagagccagccagagcgtgatcagcagattcctgagctggtatcaagtgaagcccggactggcccctcggctgttgatatatggcgcctctacacgcgccacaggcatccctgttagattttctggcagcggctccggcaccgacttcagcctgacaattagcagcctgcagcctgaggactgcgccgtgtactactgtcagcaggacagcaacctgcctatcaccttcggccagggcaccagactggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 253 - DNA, 1008 bp, Artificial Sequence; identical to SEQ ID NO: 229
  Synthetic Construct

SEQ ID NO: 254 - DNA, 1731 bp, Artificial Sequence; identical to SEQ ID NO: 190
  Synthetic Construct

SEQ ID NO: 255 - DNA, 1320 bp, Artificial Sequence
  Synthetic Construct
caggttcagctgcagcagtctggccccgaactcgttagacctggcacctctgtgaaggtgtcctgcaaggccagcggctacgcctttaccacctacctggtggaatggatcaagcagaggcctggacagggcctcgagtggatcggagtgatcaatcctggcagcggcagcaccaactacaacgagaagttcaagggcaaagccacactgaccgtggacagaagcagcaccacagcctacatgcacctgagcggcctgacctctgatgacagcgccgtgtacttctgcgccagatacgcctatggctattggggccagggcacaaccctgaccgttagctctgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 256 - DNA, 642 bp, Artificial Sequence
  Synthetic Construct
gacatcgtgatgacccagagccagaaattcatgagcgccagcgtgggcgacagagtgtccatcacatgtaaagccagccagaacgtgggcacagccgtggcttggtatcagcagcagcctggccactctcctaagcagctgatctacagcgccagcaacagatacaccggcgtgcccgatagattcacaggatctggcgccggaaccgacttcaccctgaccatcagcaacatccagagcgaggacctggccgactacttctgccagcagtacagcacataccccttcacctttggcagcggcaccaagctggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 257 - DNA, 1008 bp, Artificial Sequence; identical to SEQ ID NO: 229
  Synthetic Construct

SEQ ID NO: 258 - DNA, 1731 bp, Artificial Sequence; identical to SEQ ID NO: 190
  Synthetic Construct

SEQ ID NO: 259 - DNA, 1338 bp, Artificial Sequence
  Synthetic Construct
caggttcagctgctgcagtctggcgccgaacttgtcagacctggcgtgtccgtgaagatcagctgtacaggcagcggctacagcttcaccaactacgccgtgcactgggtcaagcagagccacgtgaagtccctggaatggatcggcgtgatcagcccctactacggcgacaccacctacaaccagaagttcaccggcaaggccaccatgaccgtggacaagtctagcagcaccgcctacatggaactggccagactgaccagcgaggacagcgccatctacttttgcgccagaagattcgagggcttctactacagcatggactactggggccagggcaccagcgtgacagtttcttctgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 260 - DNA, 657 bp, Artificial Sequence
  Synthetic Construct
gacgtggtcatgatccagacacctctgagcctgcctgtgtctctgggagatcaggccagcatcagctgcagacctagccagtctctggtgcacagcaacggcaacacctacctgaactggtatctgcagaggcccggacagagccccaagctgctgatctacaaggtgtccaagcggttcagcggcgtgcccgatagattttctggcagcggctctggcaccgacttcaccctgaagattagcagagtggaagccgaggacctgggcgtgtacctgtgttctcagagcacacacgtgcccctgacctttggcagcggaacccagctggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 261 - DNA, 1008 bp, Artificial Sequence; identical to SEQ ID NO: 229
  Synthetic Construct

SEQ ID NO: 262 - DNA, 1731 bp, Artificial Sequence; identical to SEQ ID NO: 190
  Synthetic Construct

SEQ ID NO: 263 - DNA, 1344 bp, Artificial Sequence
  Synthetic Construct
caggtgcagctggtggaatctggcggcggagtggtgcagcctggcagaagcctgagactgagctgtgccgccagcggcttcaccttcagcagctacggcatgtactgggtgcgccaggcccctggcaaaggcctggaatgggtggccgtgatttggtacgacggcagcaacaagtactacgccgacagcgtgaagggccggttcaccatctcccgggacaacagcaagaacaccctgtacctgcagatgaacagcctgcgggccgaggacacagccgtgtatcactgcgccagagatcccggcctgcggtactttgacggcggcatggatgtgtggggccagggcacaaccgtgaccgtgtcatctgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 264 - DNA, 642 bp, Artificial Sequence
  Synthetic Construct
gacatccagctgacccagagccccagctttctgagcgccagcgtgggcgacagagtgaccatcacctgtagagccagccagggcatcagcagctacctggcctggtatcagcagaagcccggcaaggcccccaaactgctgatctttgccgccagcacactgcacagcggcgtgcccagcagattttctggcagcggctccggcaccgagttcaccctgacaatcagcagcctgcagcccgaggacttcgccacctactactgccagcagctgaacagcttcccctacaccttcggccagggcaccaagctggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 265 - DNA, 1008 bp, Artificial Sequence; identical to SEQ ID NO: 229
  Synthetic Construct

SEQ ID NO: 266 - DNA, 1731 bp, Artificial Sequence; identical to SEQ ID NO: 190
  Synthetic Construct

SEQ ID NO: 267 - DNA, 1329 bp, Artificial Sequence
  Synthetic Construct
caggtgcagctggtggaaagcggcggaggcgtggtgcagcctggcaggtctctgagactgagctgtgccgccagcggcttcaccttcagcagctacggaatgcactgggtgcgccaggcccctggcaaaggactggaatgggtggccgtgatttggtacgacggcagcaacaagtactacgccgacagcgtgaagggccggttcaccatcagcggcgacaacagcaagaacaccctgtacctgcagatgaacagcctgcgggccgaggacaccgccgtgtactactgcgccagaatgttcagaggcgccttcgactactggggccagggcacactcgtgaccgtgtctagtgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 268 - DNA, 642 bp, Artificial Sequence
  Synthetic Construct
gccatccagatgacccagagccccagcagcctgtctgccagcgtgggcgacagagtgaccatcacctgtagagccagccagggcatccggaacgacctgggctggtatcagcagaagcctggcaaggcccccaagctgctgatctacgccgctagctctctgcagtccggcgtgcccagcagattttctggcagcggctccggcaccgacttcaccctgacaatctctggcctgcagcccgaggacagcgccacctactactgtctgcaagactacatctactaccccaccttcggccagggcaccaaggtggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 269 - DNA, 1008 bp, Artificial Sequence; identical to SEQ ID NO: 229
  Synthetic Construct

SEQ ID NO: 270 - DNA, 1731 bp, Artificial Sequence; identical to SEQ ID NO: 190
  Synthetic Construct

SEQ ID NO: 271 - DNA, 1320 bp, Artificial Sequence
  Synthetic Construct
caggttcagctggttcagtctggcgccgaagtgaagaaacctggcgcctctgtgaaggtgtcctgcaaggcctctggctacgccttcaccacctacctggtggaatggatcagacagaggcctggacagggcctcgaatggatgggcgtgatcaatcctggcagcggcagcaccaattacgcccagaaattccagggcagagtgaccatgaccgtggacagaagcagcaccaccgcctacatggaactgagcagactgagaagcgacgacaccgccgtgtactactgtgccagatacgcctacggctattggggccagggaaccctggttaccgttagctctgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 272 - DNA, 642 bp, Artificial Sequence
  Synthetic Construct
gacatccagatgacacagagccctagcagcctgtctgccagcgtgggagacagagtgaccatcacctgtagagccagccagaatgtgggaacagccgtggcctggtatcagcagaagcctggcaagagccccaagcagctgatctacagcgccagcaacagatacaccggcgtgcccagcagattttctggcagcggctctggcaccgacttcaccctgaccatatctagcctgcagcctgaggacctggccacctactactgtcagcagtacagcacataccccttcaccttcggccagggcaccaagctggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 273 - DNA, 1008 bp, Artificial Sequence; identical to SEQ ID NO: 229
  Synthetic Construct

SEQ ID NO: 274 - DNA, 1731 bp, Artificial Sequence; identical to SEQ ID NO: 190
  Synthetic Construct

SEQ ID NO: 275 - DNA, 1338 bp, Artificial Sequence
  Synthetic Construct
caggttcagctggttcagtctggcgccgaagtgaagaaacctggcgcctctgtgaaggtgtcctgcaaggccagcggctacagcttcaccaattacgccgtgcactgggtccgacaggctccaggacaaggactggaatggatgggcgtgatcagcccctactacggcgataccacatacgcccagaaattccagggcagagtgaccatgaccgtggacaagagcagcagcaccgcctacatggaactgagcagactgagaagcgacgacaccgccgtgtactactgcgccagaagattcgagggcttctactacagcatggactactggggccagggcaccctggttacagtctcttctgcgtcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 276 - DNA, 657 bp, Artificial Sequence
  Synthetic Construct
gacgtggtcatgacacagagccctctgagcctgcctgtgacactgggacagcctgccagcatcagctgtagacctagccagagcctggtgcacagcaacggcaacacctacctgaactggtatcagcagaggcccggacagagccccaagctgctgatctacaaggtgtccaagcggttcagcggcgtgcccgatagattttctggcagcggctctggcaccgacttcaccctgaagattagcagagtggaagccgaggacgtgggcgtgtactactgtagccagtctacccacgtgccactgacctttggcggcggaacaaaggtggaaatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 277 - protein, 114 aa, Artificial Sequence
  Synthetic Construct
QVQLQQSGPELVRPGTSVKVSCKASGYAFTTYLVEWIKQRPGQGLEWIGVINPGSGSTNYNEKFKGKATLTVDRSSTTAYMHLSGLTSDDSAVYFCARYAYGYWGQGTTLTVSS

SEQ ID NO: 278 - protein, 107 aa, Artificial Sequence
  Synthetic Construct
DIVMTQSQKFMSASVGDRVSITCKASQNVGTAVAWYQQQPGHSPKQLIYSASNRYTGVPDRFTGSGAGTDFTLTISNIQSEDLADYFCQQYSTYPFTFGSGTKLEIK

SEQ ID NO: 279 - protein, 120 aa, Artificial Sequence
  Synthetic Construct
QVQLLQSGAELVRPGVSVKISCTGSGYSFTNYAVHWVKQSHVKSLEWIGVISPYYGDTTYNQKFTGKATMTVDKSSSTAYMELARLTSEDSAIYFCARRFEGFYYSMDYWGQGTSVTVSS

SEQ ID NO: 280 - protein, 112 aa, Artificial Sequence
  Synthetic Construct
DVVMIQTPLSLPVSLGDQASISCRPSQSLVHSNGNTYLNWYLQRPGQSPKLLIYKVSKRFSGVPDRFSGSGSGTDFTLKISRVEAEDLGVYLCSQSTHVPLTFGSGTQLEIK

SEQ ID NO: 281 - protein, 4 aa, Artificial Sequence
  Synthetic Construct
ENLQ

SEQ ID NO: 282 - protein, 4 aa, Artificial Sequence
  Synthetic Construct
ENLF

SEQ ID NO: 283 - protein, 4 aa, Artificial Sequence
  Synthetic Construct
ENLR

SEQ ID NO: 284 - protein, 9 aa, Artificial Sequence
  Synthetic Construct
NLVPMVATV

SEQ ID NO: 285 - protein, 9 aa, Artificial Sequence
  Synthetic Construct
GLCTLVAML

SEQ ID NO: 286 - protein, 336 aa, Artificial Sequence; identical to SEQ ID NO: 100
  Synthetic Construct

SEQ ID NO: 287 - protein, 577 aa, Artificial Sequence; identical to SEQ ID NO: 101
  Synthetic Construct

SEQ ID NO: 288 - protein, 446 aa, Artificial Sequence; identical to SEQ ID NO: 122
  Synthetic Construct

SEQ ID NO: 289 - protein, 214 aa, Artificial Sequence; identical to SEQ ID NO: 103
  Synthetic Construct

SEQ ID NO: 290 - protein, 338 aa, Artificial Sequence; identical to SEQ ID NO: 112
  Synthetic Construct

SEQ ID NO: 291 - protein, 577 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYAESVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG

SEQ ID NO: 292 - protein, 446 aa, Artificial Sequence; identical to SEQ ID NO: 106
  Synthetic Construct

SEQ ID NO: 293 - protein, 214 aa, Artificial Sequence; identical to SEQ ID NO: 103
  Synthetic Construct

SEQ ID NO: 294 - protein, 338 aa, Artificial Sequence; identical to SEQ ID NO: 112
  Synthetic Construct

SEQ ID NO: 295 - protein, 570 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSSQVQLVESGGGVVQPGRSLRLSCAASGFTFTKAWMHWVRQAPGKQLEWVAQIKDKSNSYATYYASSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG

SEQ ID NO: 296 - protein, 446 aa, Artificial Sequence; identical to SEQ ID NO: 106
  Synthetic Construct

SEQ ID NO: 297 - protein, 214 aa, Artificial Sequence; identical to SEQ ID NO: 103
  Synthetic Construct

SEQ ID NO: 298 - protein, 338 aa, Artificial Sequence
  Synthetic Construct
DIVMTQTPLSLSVTPGQPASISCKSSQSLVHQSAQTYLSWYLQKPGQSPQSLIYKVSNRFSGVPDRFSGSGSGTDFTLKISRVEAEDVGVYYCGQGTQYPFTFGSGTKVEIKGQPKAAPDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 570 aa, Artificial Sequence; identical to SEQ ID NO: 295
  Synthetic Construct

SEQ ID NO: 300 - protein, 446 aa, Artificial Sequence; identical to SEQ ID NO: 106
  Synthetic Construct

SEQ ID NO: 301 - protein, 214 aa, Artificial Sequence; identical to SEQ ID NO: 103
  Synthetic Construct

SEQ ID NO: 302 - protein, 5 aa, Artificial Sequence
  Synthetic Construct
NCPIN

SEQ ID NO: 303 - protein, 17 aa, Artificial Sequence
  Synthetic Construct
WMKPRHGAVSYARQLQG

SEQ ID NO: 304 - protein, 16 aa, Artificial Sequence
  Synthetic Construct
GKYCTARDYYNWDFEH

SEQ ID NO: 305 - protein, 9 aa, Artificial Sequence
  Synthetic Construct
RTSQYGSLA

SEQ ID NO: 306 - protein, 7 aa, Artificial Sequence
  Synthetic Construct
SGSTRAA

SEQ ID NO: 307 - protein, 5 aa, Artificial Sequence
  Synthetic Construct
QQYEF

SEQ ID NO: 308 - protein, 8 aa, Artificial Sequence
  Synthetic Construct
GYTFTAHI

SEQ ID NO: 309 - protein, 8 aa, Artificial Sequence
  Synthetic Construct
IKPQYGAV

SEQ ID NO: 310 - protein, 8 aa, Artificial Sequence
  Synthetic Construct
IKPQYGAT

SEQ ID NO: 311 - protein, 13 aa, Artificial Sequence
  Synthetic Construct
DRSYGDSSWALDA

SEQ ID NO: 312 - protein, 6 aa, Artificial Sequence
  Synthetic Construct
QGVGSD

SEQ ID NO: 313 - protein, 3 aa, Artificial Sequence
  Synthetic Construct
HTS

SEQ ID NO: 314 - protein, 6 aa, Artificial Sequence
  Synthetic Construct
CQVLQF

SEQ ID NO: 315 - protein, 5 aa, Artificial Sequence
  Synthetic Construct
DCTLN

SEQ ID NO: 316 - protein, 17 aa, Artificial Sequence
  Synthetic Construct
WLKPRWGAVNYARPLQG

SEQ ID NO: 317 - protein, 12 aa, Artificial Sequence
  Synthetic Construct
GKNCDYNWDFEH

SEQ ID NO: 318 - protein, 9 aa, Artificial Sequence
  Synthetic Construct
RTSQYGSLA

SEQ ID NO: 319 - protein, 7 aa, Artificial Sequence
  Synthetic Construct
SGSTRAA

SEQ ID NO: 320 - protein, 5 aa, Artificial Sequence
  Synthetic Construct
QQYEF

SEQ ID NO: 321 - protein, 8 aa, Artificial Sequence
  Synthetic Construct
GFTFTKAW

SEQ ID NO: 322 - protein, 10 aa, Artificial Sequence
  Synthetic Construct
IKDKSNSYAT

SEQ ID NO: 323 - protein, 12 aa, Artificial Sequence
  Synthetic Construct
RGVYYALSPFDY

SEQ ID NO: 324 - protein, 11 aa, Artificial Sequence
  Synthetic Construct
QSLVHNNANTY

SEQ ID NO: 325 - protein, 11 aa, Artificial Sequence
  Synthetic Construct
QSLVHQNAQTY

SEQ ID NO: 326 - protein, 11 aa, Artificial Sequence
  Synthetic Construct
QSLVHENLQTY

SEQ ID NO: 327 - protein, 11 aa, Artificial Sequence
  Synthetic Construct
QSLVHENLFTY

SEQ ID NO: 328 - protein, 11 aa, Artificial Sequence
  Synthetic Construct
QSLVHENLRTY

SEQ ID NO: 329 - protein, 11 aa, Artificial Sequence
  Synthetic Construct
QSLVHDNAQTY

SEQ ID NO: 330 - protein, 3 aa, Artificial Sequence
  Synthetic Construct
KVS

SEQ ID NO: 331 - protein, 9 aa, Artificial Sequence
  Synthetic Construct
GQGTQYPFT

SEQ ID NO: 332 - protein, 8 aa, Artificial Sequence
  Synthetic Construct
GYTFTSYY

SEQ ID NO: 333 - protein, 8 aa, Artificial Sequence
  Synthetic Construct
IYPGNVNT

SEQ ID NO: 334 - protein, 13 aa, Artificial Sequence
  Synthetic Construct
TRSHYGLDWNFDV

SEQ ID NO: 335 - protein, 6 aa, Artificial Sequence
  Synthetic Construct
QNIYVW

SEQ ID NO: 336 - protein, 3 aa, Artificial Sequence
  Synthetic Construct
KAS

SEQ ID NO: 337 - protein, 8 aa, Artificial Sequence
  Synthetic Construct
QQGQTYPY

SEQ ID NO: 338 - protein, 5 aa, Artificial Sequence
  Synthetic Construct
DKTHT

SEQ ID NO: 339 - protein, 7 aa, Artificial Sequence
  Synthetic Construct
GQPKAAP

SEQ ID NO: 340 - protein, 5 aa, Artificial Sequence
  Synthetic Construct
TKGPS

SEQ ID NO: 341 - protein, 10 aa, Artificial Sequence
  Synthetic Construct
GGGGSGGGGS

SEQ ID NO: 342 - protein, 15 aa, Artificial Sequence
  Synthetic Construct
GGGGSGGGGSGGGGS

SEQ ID NO: 343 - protein, 10 aa, Artificial Sequence
  Synthetic Construct
GGSGSSGSGG

SEQ ID NO: 344 - protein, 125 aa, Artificial Sequence
  Synthetic Construct
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSS

SEQ ID NO: 345 - protein, 132 aa, Artificial Sequence
  Synthetic Construct
QVRLSQSGGQMKKPGDSMRISCRASGYEFINCPINWIRLAPGKRPEWMGWMKPRHGAVSYARQLQGRVTMTRQLSQDPDDPDWGTAFLELRSLTSDDTAVYFCTRGKYCTARDYYNWDFEHWGQGTPVTVSS

SEQ ID NO: 346 - protein, 101 aa, Artificial Sequence
  Synthetic Construct
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 347 - protein, 122 aa, Artificial Sequence [sequence omitted]

SEQ ID NO: 348 - protein, 122 aa, Artificial Sequence
  Synthetic Construct
RAHLVQSGTAMKKPGASVRVSCQTSGYTFTAHILFWFRQAPGRGLEWVGWIKPQYGATNFGGGFRDRVTLTRDVYREIAYMDIRGLKPDDTAVYYCARDRSYGDSSWALDAWGQGTTVVVSA

SEQ ID NO: 349 - protein, 129 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRQLSQDPDDPDWGIAYMDIRGLKPDDTAVYYCARDRSYGDSSWALDAWGQGTTVVVSA

SEQ ID NO: 350 - protein, 103 aa, Artificial Sequence [sequence omitted]

SEQ ID NO: 351 - protein, 128 aa, Artificial Sequence
  Synthetic Construct
QVQLVQSGGQMKKPGESMRISCRASGYEFIDCTLNWIRLAPGKRPEWMGWLKPRWGAVNYARPLQGRVTMTRQLSQDPDDPDWGTAFLELRSLTVDDTAVYFCTRGKNCDYNWDFEHWGRGTPVIVSS

SEQ ID NO: 352 - protein, 100 aa, Artificial Sequence
  Synthetic Construct
LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 353 - protein, 121 aa, Artificial Sequence; identical to SEQ ID NO: 93
  Synthetic Construct

SEQ ID NO: 354 - protein, 112 aa, Artificial Sequence; identical to SEQ ID NO: 94
  Synthetic Construct

SEQ ID NO: 355 - protein, 112 aa, Artificial Sequence; identical to SEQ ID NO: 95
  Synthetic Construct

SEQ ID NO: 356 - protein, 112 aa, Artificial Sequence; identical to SEQ ID NO: 96
  Synthetic Construct

SEQ ID NO: 357 - protein, 112 aa, Artificial Sequence; identical to SEQ ID NO: 97
  Synthetic Construct

SEQ ID NO: 358 - protein, 112 aa, Artificial Sequence; identical to SEQ ID NO: 98
  Synthetic Construct

SEQ ID NO: 359 - protein, 112 aa, Artificial Sequence; identical to SEQ ID NO: 99
  Synthetic Construct

SEQ ID NO: 360 - protein, 120 aa, Artificial Sequence; identical to SEQ ID NO: 91
  Synthetic Construct

SEQ ID NO: 361 - protein, 107 aa, Artificial Sequence; identical to SEQ ID NO: 92
  Synthetic Construct

SEQ ID NO: 362 - protein, 338 aa, Artificial Sequence; identical to SEQ ID NO: 116
  Synthetic Construct

SEQ ID NO: 363 - protein, 573 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 364 - protein, 454 aa, Artificial Sequence
  Synthetic Construct
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 365 - protein, 208 aa, Artificial Sequence
  Synthetic Construct
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - protein, 338 aa, Artificial Sequence; identical to SEQ ID NO: 116
  Synthetic Construct

SEQ ID NO: 367 - protein, 573 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNNASRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 368 - protein, 454 aa, Artificial Sequence
  Synthetic Construct
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNNASRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 369 - protein, 208 aa, Artificial Sequence; identical to SEQ ID NO: 365
  Synthetic Construct

SEQ ID NO: 370 - protein, 338 aa, Artificial Sequence; identical to SEQ ID NO: 116
  Synthetic Construct

SEQ ID NO: 371 - protein, 570 aa, Artificial Sequence; identical to SEQ ID NO: 113
  Synthetic Construct

SEQ ID NO: 372 - protein, 451 aa, Artificial Sequence
  Synthetic Construct
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 373 - protein, 208 aa, Artificial Sequence; identical to SEQ ID NO: 365
  Synthetic Construct

SEQ ID NO: 374 - protein, 338 aa, Artificial Sequence; identical to SEQ ID NO: 112
  Synthetic Construct

SEQ ID NO: 375 - protein, 570 aa, Artificial Sequence; identical to SEQ ID NO: 113
  Synthetic Construct

SEQ ID NO: 376 - protein, 451 aa, Artificial Sequence; identical to SEQ ID NO: 372
  Synthetic Construct

SEQ ID NO: 377 - protein, 208 aa, Artificial Sequence; identical to SEQ ID NO: 365
  Synthetic Construct

SEQ ID NO: 378 - protein, 336 aa, Artificial Sequence; identical to SEQ ID NO: 100
  Synthetic Construct

SEQ ID NO: 379 - protein, 570 aa, Artificial Sequence; identical to SEQ ID NO: 113
  Synthetic Construct

SEQ ID NO: 380 - protein, 451 aa, Artificial Sequence; identical to SEQ ID NO: 372
  Synthetic Construct

SEQ ID NO: 381 - protein, 208 aa, Artificial Sequence; identical to SEQ ID NO: 365
  Synthetic Construct

SEQ ID NO: 382 - protein, 336 aa, Artificial Sequence; identical to SEQ ID NO: 100
  Synthetic Construct

SEQ ID NO: 383 - protein, 580 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNNASRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 384 - protein, 454 aa, Artificial Sequence; identical to SEQ ID NO: 368
  Synthetic Construct

SEQ ID NO: 385 - protein, 208 aa, Artificial Sequence; identical to SEQ ID NO: 365
  Synthetic Construct

SEQ ID NO: 386 - protein, 336 aa, Artificial Sequence; identical to SEQ ID NO: 140
  Synthetic Construct

SEQ ID NO: 387 - protein, 570 aa, Artificial Sequence; identical to SEQ ID NO: 113
  Synthetic Construct

SEQ ID NO: 388 - protein, 458 aa, Artificial Sequence
  Synthetic Construct
QVRLSQSGGQMKKPGDSMRISCRASGYEFINCPINWIRLAPGKRPEWMGWMKPRHGAVSYARQLQGRVTMTRQLSQDPDDPDWGTAFLELRSLTSDDTAVYFCTRGKYCTARDYYNWDFEHWGQGTPVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 389 - protein, 208 aa, Artificial Sequence; identical to SEQ ID NO: 365
  Synthetic Construct

SEQ ID NO: 390 - protein, 336 aa, Artificial Sequence; identical to SEQ ID NO: 144
  Synthetic Construct

SEQ ID NO: 391 - protein, 570 aa, Artificial Sequence; identical to SEQ ID NO: 113
  Synthetic Construct

SEQ ID NO: 392 - protein, 458 aa, Artificial Sequence; identical to SEQ ID NO: 388
  Synthetic Construct

SEQ ID NO: 393 - protein, 208 aa, Artificial Sequence; identical to SEQ ID NO: 365
  Synthetic Construct

SEQ ID NO: 394 - protein, 336 aa, Artificial Sequence; identical to SEQ ID NO: 140
  Synthetic Construct

SEQ ID NO: 395 - protein, 580 aa, Artificial Sequence; identical to SEQ ID NO: 383
  Synthetic Construct

SEQ ID NO: 396 - protein, 461 aa, Artificial Sequence
  Synthetic Construct
QVRLSQSGGQMKKPGDSMRISCRASGYEFINCPINWIRLAPGKRPEWMGWMKPRHGAVSYARQLQGRVTMTRQLSQDPDDPDWGTAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNNASRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 397 - protein, 208 aa, Artificial Sequence; identical to SEQ ID NO: 365
  Synthetic Construct

SEQ ID NO: 398 - protein, 336 aa, Artificial Sequence; identical to SEQ ID NO: 144
  Synthetic Construct

SEQ ID NO: 399 - protein, 580 aa, Artificial Sequence; identical to SEQ ID NO: 383
  Synthetic Construct

SEQ ID NO: 400 - protein, 461 aa, Artificial Sequence; identical to SEQ ID NO: 396
  Synthetic Construct

SEQ ID NO: 401 - protein, 208 aa, Artificial Sequence; identical to SEQ ID NO: 365
  Synthetic Construct

SEQ ID NO: 402 - protein, 338 aa, Artificial Sequence; identical to SEQ ID NO: 116
  Synthetic Construct

SEQ ID NO: 403 - protein, 569 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLG

SEQ ID NO: 404 - protein, 447 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 405 - protein, 210 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 338 aa, Artificial Sequence; identical to SEQ ID NO: 116
  Synthetic Construct

SEQ ID NO: 407 - protein, 570 aa, Artificial Sequence; identical to SEQ ID NO: 113
  Synthetic Construct

SEQ ID NO: 408 - protein, 448 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 409 - protein, 210 aa, Artificial Sequence; identical to SEQ ID NO: 405
  Synthetic Construct

SEQ ID NO: 410 - protein, 338 aa, Artificial Sequence; identical to SEQ ID NO: 112
  Synthetic Construct

SEQ ID NO: 411 - protein, 570 aa, Artificial Sequence; identical to SEQ ID NO: 113
  Synthetic Construct

SEQ ID NO: 412 - protein, 448 aa, Artificial Sequence; identical to SEQ ID NO: 408
  Synthetic Construct

SEQ ID NO: 413 - protein, 210 aa, Artificial Sequence; identical to SEQ ID NO: 405
  Synthetic Construct

SEQ ID NO: 414 - protein, 336 aa, Artificial Sequence; identical to SEQ ID NO: 100
  Synthetic Construct

SEQ ID NO: 415 - protein, 577 aa, Artificial Sequence; identical to SEQ ID NO: 101
  Synthetic Construct

SEQ ID NO: 416 - protein, 448 aa, Artificial Sequence; identical to SEQ ID NO: 408
  Synthetic Construct

SEQ ID NO: 417 - protein, 210 aa, Artificial Sequence; identical to SEQ ID NO: 405
  Synthetic Construct

SEQ ID NO: 418 - protein, 336 aa, Artificial Sequence; identical to SEQ ID NO: 132
  Synthetic Construct

SEQ ID NO: 419 - protein, 577 aa, Artificial Sequence; identical to SEQ ID NO: 101
  Synthetic Construct

SEQ ID NO: 420 - protein, 448 aa, Artificial Sequence; identical to SEQ ID NO: 408
  Synthetic Construct

SEQ ID NO: 421 - protein, 210 aa, Artificial Sequence; identical to SEQ ID NO: 405
  Synthetic Construct

SEQ ID NO: 422 - protein, 336 aa, Artificial Sequence; identical to SEQ ID NO: 100
  Synthetic Construct

SEQ ID NO: 423 - protein, 580 aa, Artificial Sequence; identical to SEQ ID NO: 383
  Synthetic Construct

SEQ ID NO: 424 - protein, 451 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNNASRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 425 - protein, 210 aa, Artificial Sequence; identical to SEQ ID NO: 405
  Synthetic Construct

SEQ ID NO: 426 - protein, 336 aa, Artificial Sequence; identical to SEQ ID NO: 108
  Synthetic Construct

SEQ ID NO: 427 - protein, 577 aa, Artificial Sequence; identical to SEQ ID NO: 101
  Synthetic Construct

SEQ ID NO: 428 - protein, 448 aa, Artificial Sequence; identical to SEQ ID NO: 408
  Synthetic Construct

SEQ ID NO: 429 - protein, 210 aa, Artificial Sequence; identical to SEQ ID NO: 405
  Synthetic Construct

SEQ ID NO: 430 - protein, 336 aa, Artificial Sequence; identical to SEQ ID NO: 140
  Synthetic Construct

SEQ ID NO: 431 - protein, 577 aa, Artificial Sequence; identical to SEQ ID NO: 101
  Synthetic Construct

SEQ ID NO: 432 - protein, 448 aa, Artificial Sequence; identical to SEQ ID NO: 408
  Synthetic Construct

SEQ ID NO: 433 - protein, 210 aa, Artificial Sequence; identical to SEQ ID NO: 405
  Synthetic Construct

SEQ ID NO: 434 - protein, 336 aa, Artificial Sequence; identical to SEQ ID NO: 136
  Synthetic Construct

SEQ ID NO: 435 - protein, 577 aa, Artificial Sequence; identical to SEQ ID NO: 101
  Synthetic Construct

SEQ ID NO: 436 - protein, 448 aa, Artificial Sequence; identical to SEQ ID NO: 408
  Synthetic Construct

SEQ ID NO: 437 - protein, 210 aa, Artificial Sequence; identical to SEQ ID NO: 405
  Synthetic Construct

SEQ ID NO: 438 - protein, 336 aa, Artificial Sequence; identical to SEQ ID NO: 144
  Synthetic Construct

SEQ ID NO: 439 - protein, 577 aa, Artificial Sequence; identical to SEQ ID NO: 101
  Synthetic Construct

SEQ ID NO: 440 - protein, 448 aa, Artificial Sequence; identical to SEQ ID NO: 408
  Synthetic Construct

SEQ ID NO: 441 - protein, 210 aa, Artificial Sequence; identical to SEQ ID NO: 405
  Synthetic Construct

SEQ ID NO: 442 - protein, 336 aa, Artificial Sequence; identical to SEQ ID NO: 140
  Synthetic Construct

SEQ ID NO: 443 - protein, 577 aa, Artificial Sequence; identical to SEQ ID NO: 101
  Synthetic Construct

SEQ ID NO: 444 - protein, 448 aa, Artificial Sequence
  Synthetic Construct
RAHLVQSGTAMKKPGASVRVSCQTSGYTFTAHILFWFRQAPGRGLEWVGWIKPQYGATNFGGGFRDRVTLTRDVYREIAYMDIRGLKPDDTAVYYCARDRSYGDSSWALDAWGQGTTVVVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 445 - protein, 210 aa, Artificial Sequence
  Synthetic Construct
YIHVTQSPSSLSVSIGDRVTINCQTSQGVGSDLHWYQHKPGRAPKLLIHHTSSSEEGVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 336 aa, Artificial Sequence; identical to SEQ ID NO: 144
  Synthetic Construct

SEQ ID NO: 447 - protein, 577 aa, Artificial Sequence; identical to SEQ ID NO: 101
  Synthetic Construct

SEQ ID NO: 448 - protein, 448 aa, Artificial Sequence; identical to SEQ ID NO: 444
  Synthetic Construct

SEQ ID NO: 449 - protein, 210 aa, Artificial Sequence; identical to SEQ ID NO: 445
  Synthetic Construct

SEQ ID NO: 450 - protein, 336 aa, Artificial Sequence; identical to SEQ ID NO: 144
  Synthetic Construct

SEQ ID NO: 451 - protein, 580 aa, Artificial Sequence; identical to SEQ ID NO: 383
  Synthetic Construct

SEQ ID NO: 452 - protein, 451 aa, Artificial Sequence
  Synthetic Construct
RAHLVQSGTAMKKPGASVRVSCQTSGYTFTAHILFWFRQAPGRGLEWVGWIKPQYGATNFGGGFRDRVTLTRDVYREIAYMDIRGLKPDDTAVYYCARDRSYGDSSWALDAWGQGTTVVVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNNASRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 453 - protein, 210 aa, Artificial Sequence; identical to SEQ ID NO: 445
  Synthetic Construct

SEQ ID NO: 454 - protein, 336 aa, Artificial Sequence; identical to SEQ ID NO: 140
  Synthetic Construct

SEQ ID NO: 455 - protein, 577 aa, Artificial Sequence; identical to SEQ ID NO: 101
  Synthetic Construct

SEQ ID NO: 456 - protein, 455 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRQLSQDPDDPDWGIAYMDIRGLKPDDTAVYYCARDRSYGDSSWALDAWGQGTTVVVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 457 - protein, 210 aa, Artificial Sequence; identical to SEQ ID NO: 405
  Synthetic Construct

SEQ ID NO: 458 - protein, 336 aa, Artificial Sequence; identical to SEQ ID NO: 144
  Synthetic Construct

SEQ ID NO: 459 - protein, 577 aa, Artificial Sequence; identical to SEQ ID NO: 101
  Synthetic Construct

SEQ ID NO: 460 - protein, 455 aa, Artificial Sequence; identical to SEQ ID NO: 456
  Synthetic Construct

SEQ ID NO: 461 - protein, 210 aa, Artificial Sequence; identical to SEQ ID NO: 405
  Synthetic Construct

SEQ ID NO: 462 - protein, 336 aa, Artificial Sequence; identical to SEQ ID NO: 140
  Synthetic Construct

SEQ ID NO: 463 - protein, 580 aa, Artificial Sequence; identical to SEQ ID NO: 383
  Synthetic Construct

SEQ ID NO: 464 - protein, 458 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRQLSQDPDDPDWGIAYMDIRGLKPDDTAVYYCARDRSYGDSSWALDAWGQGTTVVVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNNASRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 465 - protein, 210 aa, Artificial Sequence; identical to SEQ ID NO: 405
  Synthetic Construct

SEQ ID NO: 466 - protein, 336 aa, Artificial Sequence; identical to SEQ ID NO: 144
  Synthetic Construct

SEQ ID NO: 467 - protein, 580 aa, Artificial Sequence; identical to SEQ ID NO: 383
  Synthetic Construct

SEQ ID NO: 468 - protein, 458 aa, Artificial Sequence; identical to SEQ ID NO: 464
  Synthetic Construct

SEQ ID NO: 469 - protein, 210 aa, Artificial Sequence; identical to SEQ ID NO: 405
  Synthetic Construct

SEQ ID NO: 470 - protein, 336 aa, Artificial Sequence; identical to SEQ ID NO: 140
  Synthetic Construct

SEQ ID NO: 471 - protein, 577 aa, Artificial Sequence; identical to SEQ ID NO: 101
  Synthetic Construct

SEQ ID NO: 472 - protein, 454 aa, Artificial Sequence
  Synthetic Construct
QVQLVQSGGQMKKPGESMRISCRASGYEFIDCTLNWIRLAPGKRPEWMGWLKPRWGAVNYARPLQGRVTMTRQLSQDPDDPDWGTAFLELRSLTVDDTAVYFCTRGKNCDYNWDFEHWGRGTPVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLG

SEQ ID NO: 473 - protein, 207 aa, Artificial Sequence
  Synthetic Construct
LTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 474 - protein, 336 aa, Artificial Sequence; identical to SEQ ID NO: 144
  Synthetic Construct

SEQ ID NO: 475 - protein, 577 aa, Artificial Sequence; identical to SEQ ID NO: 101
  Synthetic Construct

SEQ ID NO: 476 - protein, 454 aa, Artificial Sequence; identical to SEQ ID NO: 472
  Synthetic Construct

SEQ ID NO: 477 - protein, 207 aa, Artificial Sequence; identical to SEQ ID NO: 473
  Synthetic Construct

SEQ ID NO: 478 - DNA, 1014 bp, Artificial Sequence; identical to SEQ ID NO: 205
  Synthetic Construct

SEQ ID NO: 479 - DNA, 1725 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcagccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgccagcacaaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaagccgccggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctggccgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggctagtga

SEQ ID NO: 480 - DNA, 1362 bp, Artificial Sequence
  Synthetic Construct
caagtgcggctgtctcagtctggcggccagatgaagaaacccggcgacagcatgcggatcagctgcagagccagcggctacgagttcatcaactgccccatcaactggatcagactggcccctggcaagcggcctgagtggatgggatggatgaagcccagacacggggccgtgtcctacgccagacagctgcagggcagagtgaccatgacccgggacatgtacagcgagacagccttcctggaactgcggagcctgaccagcgacgataccgccgtgtacttctgcacccggggcaagtactgcaccgccagagactactacaactgggacttcgagcactggggccagggcacacctgtgacagtgtctagcgcttcgaccaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaagccgccggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctggccgcccccatcgagaaaaccatcagcaaggccaagggccagccccgcgaaccccaggtgtacacactgcccccatgcagggacgagctgaccaagaaccaggtgtccctgtggtgtctggtgaaaggcttctacccctccgatatcgccgtggaatgggagagcaacggccagcccgagaacaactacaagaccaccccccctgtgctggacagcgacggctcattcttcctgtactccaagctgacagtggacaagtcccggtggcagcagggcaacgtgttcagctgctccgtgatgcacgaggccctgcacaaccactacacccagaagtccctgagcctgagccccggc

SEQ ID NO: 481 - DNA, 624 bp, Artificial Sequence
  Synthetic Construct
agcctgacacagagccctggcaccctgtcactgagcccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 482 - DNA, 1014 bp, Artificial Sequence; identical to SEQ ID NO: 205
  Synthetic Construct

SEQ ID NO: 483 - DNA, 1719 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcagccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgccagcacaaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacaatgcctcccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggc

SEQ ID NO: 484 - DNA, 1362 bp, Artificial Sequence
  Synthetic Construct
caagtgcggctgtctcagtctggcggccagatgaagaaacccggcgacagcatgcggatcagctgcagagccagcggctacgagttcatcaactgccccatcaactggatcagactggcccctggcaagcggcctgagtggatgggatggatgaagcccagacacggggccgtgtcctacgccagacagctgcagggcagagtgaccatgacccgggacatgtacagcgagacagccttcctggaactgcggagcctgaccagcgacgataccgccgtgtacttctgcacccggggcaagtactgcaccgccagagactactacaactgggacttcgagcactggggccagggcacacctgtgacagtgtctagcgcttcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacaatgcctcccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctattcaaaactcaccgtggacaagagcaggtggcagcaggggaacgtcttctcatgctccgtgctgcatgaggctctgcacagccactacacgcagaagagcctctccctgtctccgggt

SEQ ID NO: 485 - DNA, 624 bp, Artificial Sequence; identical to SEQ ID NO: 481
  Synthetic Construct

SEQ ID NO: 486 - DNA, 1014 bp, Artificial Sequence; identical to SEQ ID NO: 205
  Synthetic Construct

SEQ ID NO: 487 - DNA, 1710 bp, Artificial Sequence; identical to SEQ ID NO: 202
  Synthetic Construct

SEQ ID NO: 488 - DNA, 1353 bp, Artificial Sequence
  Synthetic Construct
caagtgcggctgtctcagtctggcggccagatgaagaaacccggcgacagcatgcggatcagctgcagagccagcggctacgagttcatcaactgccccatcaactggatcagactggcccctggcaagcggcctgagtggatgggatggatgaagcccagacacggggccgtgtcctacgccagacagctgcagggcagagtgaccatgacccgggacatgtacagcgagacagccttcctggaactgcggagcctgaccagcgacgataccgccgtgtacttctgcacccggggcaagtactgcaccgccagagactactacaactgggacttcgagcactggggccagggcacacctgtgacagtgtctagcgcttcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 489 - DNA, 624 bp, Artificial Sequence; identical to SEQ ID NO: 481
  Synthetic Construct

SEQ ID NO: 490 - DNA, 1014 bp, Artificial Sequence; identical to SEQ ID NO: 201
  Synthetic Construct

SEQ ID NO: 491 - DNA, 1710 bp, Artificial Sequence; identical to SEQ ID NO: 202
  Synthetic Construct

SEQ ID NO: 492 - DNA, 1353 bp, Artificial Sequence; identical to SEQ ID NO: 488
  Synthetic Construct

SEQ ID NO: 493 - DNA, 624 bp, Artificial Sequence; identical to SEQ ID NO: 481
  Synthetic Construct

SEQ ID NO: 494 - DNA, 1008 bp, Artificial Sequence; identical to SEQ ID NO: 189
  Synthetic Construct

SEQ ID NO: 495 - DNA, 1731 bp, Artificial Sequence; identical to SEQ ID NO: 190
  Synthetic Construct

SEQ ID NO: 496 - DNA, 1353 bp, Artificial Sequence; identical to SEQ ID NO: 488
  Synthetic Construct

SEQ ID NO: 497 - DNA, 624 bp, Artificial Sequence; identical to SEQ ID NO: 481
  Synthetic Construct

SEQ ID NO: 498 - DNA, 1008 bp, Artificial Sequence; identical to SEQ ID NO: 189
  Synthetic Construct

SEQ ID NO: 499 - DNA, 1740 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcgacaaaacccatacccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtgataagacccacaccgccagcacaaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacaatgcctcccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggc

SEQ ID NO: 500 - DNA, 1362 bp, Artificial Sequence; identical to SEQ ID NO: 484
  Synthetic Construct

SEQ ID NO: 501 - DNA, 624 bp, Artificial Sequence; identical to SEQ ID NO: 481
  Synthetic Construct

SEQ ID NO: 502 - DNA, 1008 bp, Artificial Sequence; identical to SEQ ID NO: 229
  Synthetic Construct

SEQ ID NO: 503 - DNA, 1731 bp, Artificial Sequence; identical to SEQ ID NO: 190
  Synthetic Construct

SEQ ID NO: 504 - DNA, 1374 bp, Artificial Sequence
  Synthetic Construct
caagtgcggctgtctcagtctggcggccagatgaagaaacccggcgacagcatgcggatcagctgcagagccagcggctacgagttcatcaactgccccatcaactggatcagactggcccctggcaagcggcctgagtggatgggatggatgaagcccagacacggggccgtgtcctacgccagacagctgcagggcagagtgaccatgacccggcagctgagccaggaccctgatgatccggattggggcacagccttcctggaactgcggagcctgaccagcgacgataccgccgtgtacttctgcacccggggcaagtactgcaccgccagagactactacaactgggacttcgagcactggggccagggcacacctgtgacagtgtctagcgcttcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 505 - DNA, 624 bp, Artificial Sequence; identical to SEQ ID NO: 481
  Synthetic Construct

SEQ ID NO: 506 - DNA, 1008 bp, Artificial Sequence; identical to SEQ ID NO: 233
  Synthetic Construct

SEQ ID NO: 507 - DNA, 1731 bp, Artificial Sequence; identical to SEQ ID NO: 190
  Synthetic Construct

SEQ ID NO: 508 - DNA, 1374 bp, Artificial Sequence; identical to SEQ ID NO: 504
  Synthetic Construct

SEQ ID NO: 509 - DNA, 624 bp, Artificial Sequence; identical to SEQ ID NO: 481
  Synthetic Construct

SEQ ID NO: 510 - DNA, 1008 bp, Artificial Sequence; identical to SEQ ID NO: 229
  Synthetic Construct

SEQ ID NO: 511 - DNA, 1740 bp, Artificial Sequence; identical to SEQ ID NO: 499
  Synthetic Construct

SEQ ID NO: 512 - DNA, 1383 bp, Artificial Sequence
  Synthetic Construct
caagtgcggctgtctcagtctggcggccagatgaagaaacccggcgacagcatgcggatcagctgcagagccagcggctacgagttcatcaactgccccatcaactggatcagactggcccctggcaagcggcctgagtggatgggatggatgaagcccagacacggggccgtgtcctacgccagacagctgcagggcagagtgaccatgacccggcagctgagccaggaccctgatgatccggattggggcacagccttcctggaactgcggagcctgaccagcgacgataccgccgtgtacttctgcacccggggcaagtactgcaccgccagagactactacaactgggacttcgagcactggggccagggcacacctgtgacagtgtctagcgcttcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacaatgcctcccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 513 - DNA, 624 bp, Artificial Sequence; identical to SEQ ID NO: 481
  Synthetic Construct

SEQ ID NO: 514 - DNA, 1008 bp, Artificial Sequence; identical to SEQ ID NO: 233
  Synthetic Construct

SEQ ID NO: 515 - DNA, 1740 bp, Artificial Sequence; identical to SEQ ID NO: 499
  Synthetic Construct

SEQ ID NO: 516 - DNA, 1383 bp, Artificial Sequence; identical to SEQ ID NO: 512
  Synthetic Construct

SEQ ID NO: 517 - DNA, 624 bp, Artificial Sequence; identical to SEQ ID NO: 481
  Synthetic Construct

SEQ ID NO: 518 - DNA, 1014 bp, Artificial Sequence; identical to SEQ ID NO: 205
  Synthetic Construct

SEQ ID NO: 519 - DNA, 1707 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcagccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctcctgtggctggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggc

SEQ ID NO: 520 - DNA, 1341 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctcctgtggctggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 521 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 522 - DNA, 1014 bp, Artificial Sequence; identical to SEQ ID NO: 205
  Synthetic Construct

SEQ ID NO: 523 - DNA, 1710 bp, Artificial Sequence; identical to SEQ ID NO: 202
  Synthetic Construct

SEQ ID NO: 524 - DNA, 1344 bp, Artificial Sequence
  Synthetic Construct
  misc_feature 439: n = A,T,C or G
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccatcggtgttccctctggccccttgcagcagaagcaccagcgaatctacagccgccntgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 525 - DNA, 630 bp, Artificial Sequence; identical to SEQ ID NO: 521
  Synthetic Construct

SEQ ID NO: 526 - DNA, 1014 bp, Artificial Sequence; identical to SEQ ID NO: 205
  Synthetic Construct

SEQ ID NO: 527 - DNA, 1710 bp, Artificial Sequence; identical to SEQ ID NO: 202
  Synthetic Construct

SEQ ID NO: 528 - DNA, 1344 bp, Artificial Sequence; identical to SEQ ID NO: 524
  Synthetic Construct
  misc_feature 439: n = A,T,C or G

SEQ ID NO: 529 - DNA, 630 bp, Artificial Sequence; identical to SEQ ID NO: 521
  Synthetic Construct

SEQ ID NO: 530 - DNA, 1008 bp, Artificial Sequence; identical to SEQ ID NO: 189
  Synthetic Construct

SEQ ID NO: 531 - DNA, 1731 bp, Artificial Sequence; identical to SEQ ID NO: 190
  Synthetic Construct

SEQ ID NO: 532 - DNA, 1344 bp, Artificial Sequence; identical to SEQ ID NO: 524
  Synthetic Construct
  misc_feature 439: n = A,T,C or G

SEQ ID NO: 533 - DNA, 630 bp, Artificial Sequence; identical to SEQ ID NO: 521
  Synthetic Construct

SEQ ID NO: 534 - DNA, 1002 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacaccagtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgt

SEQ ID NO: 535 - DNA, 1731 bp, Artificial Sequence; identical to SEQ ID NO: 190
  Synthetic Construct

SEQ ID NO: 536 - DNA, 1344 bp, Artificial Sequence; identical to SEQ ID NO: 524
  Synthetic Construct
  misc_feature 439: n = A,T,C or G

SEQ ID NO: 537 - DNA, 630 bp, Artificial Sequence; identical to SEQ ID NO: 521
  Synthetic Construct

SEQ ID NO: 538 - DNA, 1008 bp, Artificial Sequence; identical to SEQ ID NO: 189
  Synthetic Construct

SEQ ID NO: 539 - DNA, 1740 bp, Artificial Sequence; identical to SEQ ID NO: 499
  Synthetic Construct

SEQ ID NO: 540 - DNA, 1353 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacaatgcctcccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 541 - DNA, 630 bp, Artificial Sequence; identical to SEQ ID NO: 521
  Synthetic Construct

SEQ ID NO: 542 - DNA, 1002 bp, Artificial Sequence
  Synthetic Construct
gacatcgtgatgacccagacccccctgagcctgagcgtgacacctggacagcctgccagcatcagctgcaagagcagccagagcctggtgcacgacaacgcccagacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaaggataagacccacaccagtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgt

SEQ ID NO: 543 - DNA, 1731 bp, Artificial Sequence; identical to SEQ ID NO: 190
  Synthetic Construct

SEQ ID NO: 544 - DNA, 1344 bp, Artificial Sequence; identical to SEQ ID NO: 524
  Synthetic Construct
  misc_feature 439: n = A,T,C or G

SEQ ID NO: 545 - DNA, 630 bp, Artificial Sequence; identical to SEQ ID NO: 521
  Synthetic Construct

SEQ ID NO: 546 - DNA, 1008 bp, Artificial Sequence; identical to SEQ ID NO: 229
  Synthetic Construct

SEQ ID NO: 547 - DNA, 1731 bp, Artificial Sequence; identical to SEQ ID NO: 190
  Synthetic Construct

SEQ ID NO: 548 - DNA, 1344 bp, Artificial Sequence; identical to SEQ ID NO: 524
  Synthetic Construct
  misc_feature 439: n = A,T,C or G

SEQ ID NO: 549 - DNA, 630 bp, Artificial Sequence; identical to SEQ ID NO: 521
  Synthetic Construct

SEQ ID NO: 550 - DNA, 1008 bp, Artificial Sequence; identical to SEQ ID NO: 225
  Synthetic Construct

SEQ ID NO: 551 - DNA, 1731 bp, Artificial Sequence; identical to SEQ ID NO: 190
  Synthetic Construct

SEQ ID NO: 552 - DNA, 1344 bp, Artificial Sequence; identical to SEQ ID NO: 524
  Synthetic Construct
  misc_feature 439: n = A,T,C or G

SEQ ID NO: 553 - DNA, 630 bp, Artificial Sequence; identical to SEQ ID NO: 521
  Synthetic Construct

SEQ ID NO: 554 - DNA, 1008 bp, Artificial Sequence; identical to SEQ ID NO: 233
  Synthetic Construct

SEQ ID NO: 555 - DNA, 1731 bp, Artificial Sequence; identical to SEQ ID NO: 190
  Synthetic Construct

SEQ ID NO: 556 - DNA, 1344 bp, Artificial Sequence; identical to SEQ ID NO: 524
  Synthetic Construct
  misc_feature 439: n = A,T,C or G

SEQ ID NO: 557 - DNA, 630 bp, Artificial Sequence; identical to SEQ ID NO: 521
  Synthetic Construct

SEQ ID NO: 558 - DNA, 1008 bp, Artificial Sequence; identical to SEQ ID NO: 229
  Synthetic Construct

SEQ ID NO: 559 - DNA, 1731 bp, Artificial Sequence; identical to SEQ ID NO: 190
  Synthetic Construct

SEQ ID NO: 560 - DNA, 1344 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccaccaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 561 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagctccgaagagggcgtgcccagcagattttccggcagcggcttccacaccagcttcaacctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 562 - DNA, 1008 bp, Artificial Sequence; identical to SEQ ID NO: 233
  Synthetic Construct

SEQ ID NO: 563 - DNA, 1731 bp, Artificial Sequence; identical to SEQ ID NO: 190
  Synthetic Construct

SEQ ID NO: 564 - DNA, 1344 bp, Artificial Sequence; identical to SEQ ID NO: 560
  Synthetic Construct

SEQ ID NO: 565 - DNA, 630 bp, Artificial Sequence; identical to SEQ ID NO: 561
  Synthetic Construct

SEQ ID NO: 566 - DNA, 1008 bp, Artificial Sequence; identical to SEQ ID NO: 233
  Synthetic Construct

SEQ ID NO: 567 - DNA, 1740 bp, Artificial Sequence; identical to SEQ ID NO: 499
  Synthetic Construct

SEQ ID NO: 568 - DNA, 1353 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccaccaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacaatgcctcccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 569 - DNA, 630 bp, Artificial Sequence; identical to SEQ ID NO: 561
  Synthetic Construct

SEQ ID NO: 570 - DNA, 1008 bp, Artificial Sequence; identical to SEQ ID NO: 229
  Synthetic Construct

SEQ ID NO: 571 - DNA, 1731 bp, Artificial Sequence; identical to SEQ ID NO: 190
  Synthetic Construct

SEQ ID NO: 572 - DNA, 1365 bp, Artificial Sequence
  Synthetic Construct
  misc_feature 460: n = A,T,C or G
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccggcagctgagccaggaccctgatgatccggattggggcatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccatcggtgttccctctggccccttgcagcagaagcaccagcgaatctacagccgccntgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 573 - DNA, 630 bp, Artificial Sequence; identical to SEQ ID NO: 521
  Synthetic Construct

SEQ ID NO: 574 - DNA, 1008 bp, Artificial Sequence; identical to SEQ ID NO: 233
  Synthetic Construct

SEQ ID NO: 575 - DNA, 1731 bp, Artificial Sequence; identical to SEQ ID NO: 190
  Synthetic Construct

SEQ ID NO: 576 - DNA, 1365 bp, Artificial Sequence; identical to SEQ ID NO: 572
  Synthetic Construct
  misc_feature 460: n = A,T,C or G

SEQ ID NO: 577 - DNA, 630 bp, Artificial Sequence; identical to SEQ ID NO: 521
  Synthetic Construct

SEQ ID NO: 578 - DNA, 1008 bp, Artificial Sequence; identical to SEQ ID NO: 229
  Synthetic Construct

SEQ ID NO: 579 - DNA, 1740 bp, Artificial Sequence; identical to SEQ ID NO: 499
  Synthetic Construct

SEQ ID NO: 580 - DNA, 1374 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccggcagctgagccaggaccctgatgatccggattggggcatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacaatgcctcccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 581 - DNA, 630 bp, Artificial Sequence; identical to SEQ ID NO: 521
  Synthetic Construct

SEQ ID NO: 582 - DNA, 1008 bp, Artificial Sequence; identical to SEQ ID NO: 233
  Synthetic Construct

SEQ ID NO: 583 - DNA, 1740 bp, Artificial Sequence; identical to SEQ ID NO: 499
  Synthetic Construct

SEQ ID NO: 584 - DNA, 1374 bp, Artificial Sequence; identical to SEQ ID NO: 580
  Synthetic Construct

SEQ ID NO: 585 - DNA, 630 bp, Artificial Sequence; identical to SEQ ID NO: 521
  Synthetic Construct

SEQ ID NO: 586 - DNA, 1008 bp, Artificial Sequence; identical to SEQ ID NO: 229
  Synthetic Construct

SEQ ID NO: 587 - DNA, 1731 bp, Artificial Sequence; identical to SEQ ID NO: 190
  Synthetic Construct

SEQ ID NO: 588 - DNA, 1362 bp, Artificial Sequence
  Synthetic Construct
  misc_feature 457, 518, 520: n = A,T,C or G
caggtgcagctggtgcagtctggcggccagatgaagaaacccggcgagagcatgcggatcagctgcagagccagcggctacgagttcatcgactgcaccctgaactggatcagactggcccctggcaagcggcctgagtggatgggatggctgaagcctagatggggagccgtgaactacgccagacctctgcagggcagagtgaccatgacccggcagctgagccaggaccctgatgatccggattggggcaccgccttcctggaactgcggagcctgaccgtggatgataccgccgtgtacttctgcacccggggcaagaactgcgactacaactgggacttcgagcactggggcagaggcacccctgtgatcgtgtcaagcgcgtcgaccaagggcccatcggtgttccctctggccccttgcagcagaagcaccagcgaatctacagccgccntgggctgcctcgtgaaggactactttcccgagcccgtgaccgtgtcctggaactctggcgntntgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaagctgccggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggc

SEQ ID NO: 589 - DNA, 621 bp, Artificial Sequence
  Synthetic Construct
ctgacacagagccctggcaccctgtcactgagcccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 590 - DNA, 1008 bp, Artificial Sequence; identical to SEQ ID NO: 233
  Synthetic Construct

SEQ ID NO: 591 - DNA, 1731 bp, Artificial Sequence; identical to SEQ ID NO: 190
  Synthetic Construct

SEQ ID NO: 592 - DNA, 1362 bp, Artificial Sequence; identical to SEQ ID NO: 588
  Synthetic Construct
  misc_feature 457, 518, 520: n = A,T,C or G

SEQ ID NO: 593 - DNA, 621 bp, Artificial Sequence; identical to SEQ ID NO: 589
  Synthetic Construct

SEQ ID NO: 594 - protein, 11 aa, Artificial Sequence
  Synthetic Construct
  VARIANT 6: Xaa = Glu or Gln
  VARIANT 8: Xaa = Ala or Leu
  VARIANT 9: Xaa = Gln, Arg, or Phe
QSLVHXNXXTY

SEQ ID NO: 595 - protein, 121 aa, Artificial Sequence
  Synthetic Construct
QVQLVESGGGVVQPGRSLRLSCAASGFTFTKAWMHWVRQAPGKQLEWVAQIKDKSNSYATYYASSVKGRFTISRDDSKNTLYLQMNSLRAEDTAVYYCRGVYYALSPFDYWGQGTLVTVSS

What is claimed is:

1. A binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:

$V_{L1}$ is a first immunoglobulin light chain variable domain;

$V_{L2}$ is a second immunoglobulin light chain variable domain;

$V_{L3}$ is a third immunoglobulin light chain variable domain;

$V_{H1}$ is a first immunoglobulin heavy chain variable domain;

$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is an immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$ and $L_4$ are amino acid linkers;

wherein the polypeptide of formula I and the polypeptide of formula II form a cross-over light chain-heavy chain pair; and wherein $V_{H1}$ and $V_{L1}$ form a first antigen binding site;

wherein $V_{H2}$ and $V_{L2}$ form a second antigen binding site that binds a CD3 polypeptide, wherein the $V_{H2}$ domain comprises a CDR-H1 sequence comprising the amino acid sequence of GFTFTKAW (SEQ ID NO:55), a CDR-H2 sequence comprising the amino acid sequence of IKDKSN- SYAT (SEQ ID NO:56), and a CDR-H3 sequence comprising the amino acid sequence of RGVYYALSPFDY (SEQ ID NO:57), and the $V_{L2}$ domain comprises a CDR-L1 sequence comprising the amino acid sequence of QSLVHX$_1$NX$_2$X$_3$TY, wherein X$_1$ is E or Q, X$_2$ is A or L, and X$_3$ is Q, R, or F (SEQ ID NO:180), a CDR-L2 sequence comprising the amino acid sequence of KVS (SEQ ID NO:64), and a CDR-L3 sequence comprising the amino acid sequence of GQGTQYPFT (SEQ ID NO:65); and wherein $V_{H3}$ and $V_{L3}$ form a third antigen binding site.

2. The binding protein of claim 1, wherein the first binding site binds a CD28 polypeptide.

3. The binding protein of claim 2, wherein the $V_{H1}$ domain comprises a CDR-H1 sequence comprising the amino acid sequence of GYTFTSYY (SEQ ID NO:49), a CDR-H2 sequence comprising the amino acid sequence of IYPGNVNT (SEQ ID NO:50), and a CDR-H3 sequence comprising the amino acid sequence of TRSHYGLDWNFDV (SEQ ID NO:51), and the $V_{L1}$ domain comprises a CDR-L1 sequence comprising the amino acid sequence of QNIYVW (SEQ ID NO:52), a CDR-L2 sequence comprising the amino acid sequence of KAS (SEQ ID NO:53), and a CDR-L3 sequence comprising the amino acid sequence of QQGQTYPY (SEQ ID NO:54).

4. The binding protein of claim 3, wherein the $V_{H1}$ domain comprises the amino acid sequence of QVQLVQSGAEVVKPGASVKVSCKASGYTFTSYYTHWVRQAPGQGLEWIGSTYPGNVNTNY AQKFQGRATLTVDTSISTAYMELSRLRSDDTAVYYCTRSHYGLDWNFDVWGKGTTVTVSS (SEQ ID NO:91), and the $V_{L1}$ domain comprises the amino acid sequence of DIQMTQSPSSLSASVGDRVTITCQASQNIYVWLNWYQQKPGKAPKLLIYKASNLHTGVPSR FSGSGSGTDFTLTISSLQPEDIATYYCQQGQTYPYTFGQGTKLEIK (SEQ ID NO:92).

5. The binding protein of claim 1, wherein the CDR-L1 sequence of the $V_{L2}$ domain comprises an amino acid sequence selected from the group consisting of QSLVHQNAQTY (SEQ ID NO:59), QSLVHENLQTY (SEQ ID NO:60), QSLVHENLFTY (SEQ ID NO:61), and QSLVHENLRTY (SEQ ID NO:62).

6. The binding protein of claim 5, wherein the $V_{H2}$ domain comprises the amino acid sequence of QVQLVESGGGVVQPGRSLRLSCAASGFTFTKAWMHWVRQAPGKQLEWVAQIKDKSNSYA TYYADSVKGRFTISRDDSKNTLYLQMNSLRAEDTAVYYCRGVYYALSPFDYWGQGTLVT VSS (SEQ ID NO:93) or QVQLVESGGGVVQPGRSLRLSCAASGFTFTKAWMHWVRQAPGKQLEWVAQIKDKSNSYA TYYASSVKGRFTISRDDSKNTLYLQMNSLRAEDTAVYYCRGVYYALSPFDYWGQGTLVTV SS (SEQ ID NO:595), and the $V_{L2}$ domain comprises an amino acid sequence selected from the group consisting of DIVMTQTPLSLSVTPGQPASISCKSSQSLVHQNAQTYLSWYLQKPGQSPQSLIYKVSNRF SG VPDRFSGSGSGTDFTLKISRVEAEDVGVYYCGQGTQYPFTFGSGTKVEIK (SEQ ID NO:95), DIVMTQTPLSLSVTPGQPASISCKSSQSLVHENLQTYLSWYLQKPGQSPQSLIYKVSNRFSGV PDRFSGSGSGTDFTLKISRVEAEDVGVYYCGQGTQYPFTFGSGTKVEIK (SEQ ID NO:96), DIVMTQTPLSLSVTPGQPASISCKSSQSLVHENLFTYLSWYLQKPGQSPQSLIYKVSNRFSGV PDRFSGSGSGTDFTLKISRVEAEDVGVYYCGQGTQYPFTFGSGTKVEIK (SEQ ID NO:97), and DIVMTQTPLSLSVTPGQPASISCKSSQSLVHENLRTYLSWYLQKPGQSPQSLIYKVSNRFSGV PDRFSGSGSGTDFTLKISRVEAEDVGVYYCGQGTQYPFTFGSGTKVEIK (SEQ ID NO:98).

7. The binding protein of claim 1, wherein the third antigen binding site binds a tumor target protein.

8. The binding protein of claim 1, wherein the third antigen binding site binds a human CD38 polypeptide.

9. The binding protein of claim 8, wherein:

(a) the $V_{H3}$ domain comprises a CDR-H1 sequence comprising the amino acid sequence of GYTFTSYA (SEQ ID NO:13), a CDR-H2 sequence comprising the amino acid sequence of IYPGQGGT (SEQ ID NO:14), and a CDR-H3 sequence comprising the amino acid sequence of ARTGGLRRAYFTY (SEQ ID NO:15), and the $V_{L3}$ domain comprises a CDR-L1 sequence comprising the amino acid sequence of QSVSSYGQGF (SEQ ID NO:16), a CDR-L2 sequence comprising the amino acid sequence of GAS (SEQ ID NO:17), and a CDR-L3 sequence comprising the amino acid sequence of QQNKEDPWT (SEQ ID NO:18);

(b) the $V_{H3}$ domain comprises a CDR-H1 sequence comprising the amino acid sequence of GYTLTEFS (SEQ ID NO:19), a CDR-H2 sequence comprising the amino acid sequence of FDPEDGET (SEQ ID NO:20), and a CDR-H3 sequence comprising the amino acid sequence of TTGRFFDWF (SEQ ID NO:21), and the $V_{L3}$ domain comprises a CDR-L1 sequence comprising the amino acid sequence of QSVISRF (SEQ ID NO:22), a CDR-L2 sequence comprising the amino acid sequence of GAS (SEQ ID NO:23), and a CDR-L3 sequence comprising the amino acid sequence of QQDSNLPIT (SEQ ID NO:24);

(c) the $V_{H3}$ domain comprises a CDR-H1 sequence comprising the amino acid sequence of GYAFTTYL (SEQ ID NO:25), a CDR-H2 sequence comprising the amino acid sequence of INPGSGST (SEQ ID NO:26), and a CDR-H3 sequence comprising the amino acid sequence of ARYAYGY (SEQ ID NO:27), and the $V_{L3}$ domain comprises a CDR-L1 sequence comprising the amino acid sequence of QNVGTA (SEQ ID NO:28), a CDR-L2 sequence comprising the amino acid sequence of SAS (SEQ ID NO:29), and a CDR-L3 sequence comprising the amino acid sequence of QQYSTYPFT (SEQ ID NO:30);

(d) the $V_{H3}$ domain comprises a CDR-H1 sequence comprising the amino acid sequence of GYSFTNYA (SEQ ID NO:31), a CDR-H2 sequence comprising the amino acid sequence of ISPYYGDT (SEQ ID NO:32), and a CDR-H3 sequence comprising the amino acid sequence of ARRFEGFYYSMDY (SEQ ID NO:33), and the $V_{L3}$ domain comprises a CDR-L1 sequence comprising the amino acid sequence of QSLVHSNGNTY (SEQ ID NO:34), a CDR-L2 sequence comprising the amino acid sequence of KVS (SEQ ID NO:35), and a CDR-L3 sequence comprising the amino acid sequence of SQSTHVPLT (SEQ ID NO:36);

(e) the $V_{H3}$ domain comprises a CDR-H1 sequence comprising the amino acid sequence of GFTFSSYG (SEQ ID NO:37), a CDR-H2 sequence comprising the amino acid sequence of IWYDGSNK (SEQ ID NO:38), and a CDR-H3 sequence comprising the amino acid sequence of ARDPGLRYFDGGMDV (SEQ ID NO:39), and the $V_{L3}$ domain comprises a CDR-L1 sequence comprising the amino acid sequence of QGISSY (SEQ ID NO:40), a CDR-L2 sequence comprising the amino acid sequence of AAS (SEQ ID NO:41), and a CDR-L3 sequence comprising the amino acid sequence of QQLNSFPYT (SEQ ID NO:42); or (f) the $V_{H3}$ domain comprises a CDR-H1 sequence comprising the amino acid sequence of GFTFSSYG (SEQ ID NO:43), a CDR-H2 sequence comprising the amino acid sequence of IWYDGSNK (SEQ ID NO:44), and a CDR-H3 sequence comprising the amino acid sequence of ARMFRGAFDY (SEQ ID NO:45), and the $V_{L3}$ domain comprises a CDR-L1 sequence comprising the amino acid sequence of QGIRND (SEQ ID NO:46), a CDR-L2 sequence comprising the amino acid sequence of AAS (SEQ ID NO:47), and a CDR-L3 sequence comprising the amino acid sequence of LQDYIYYPT (SEQ ID NO:48).

10. The binding protein of claim 9, wherein:

(a) the $V_{H3}$ domain comprises the amino acid sequence of QVQLVQSGAEVVKPGASVKVSCKASGYTFTSYAMHWVKEAPGQRLEWIGYIYPGQGGTN YNQKFQGRATLTADTSASTAYMELSSLRSEDTAVYFCARTGGLRRAYFTYWGQGTLVTVS S (SEQ ID NO:79), and the $V_{L3}$ domain comprises the amino acid sequence of DIVLTQSPATLSLSPGERATISCRASQSVSSYGQGFMHWYQQKPGQPPRLLIYGASSRATGIP ARFSGSGSGTDFTLTISPLEPEDFAVYYCQQNKEDPWTFGGGTKLEIK (SEQ ID NO:80);

(b) the $V_{H3}$ domain comprises the amino acid sequence of QVQLVQSGAEVKKPGASVKVSCKVSGYTLTEFSIHWVRQAPGQGLEWMGGFDPEDGETIY AQKFQGRVIMTEDTSTDTAYMEMNSLRSEDTAIYYCTTGRFFDWFWGQGTLVTVSS (SEQ ID NO:81), and the $V_{L3}$ domain comprises the amino acid sequence of EIILTQSPAILSLSPGERATLSCRASQSVISRFLSWYQVKPGLAPRLLIYGASTRATGIPVRFSG SGSGTDFSLTISSLQPEDCAVYYCQQDSNLPITFGQGTRLEIK (SEQ ID NO:82);

(c) the $V_{H3}$ domain comprises the amino acid sequence of QVQLVQSGAEVKKPGASVKVSCKASGYAFTTYLVEWIRQRPGQGLEWMGVINPGSGSTNY AQKFQGRVTMTVDRSSTTAYMELSRLRSDDTAVYYCARYAYGYWGQGTLVTVSS (SEQ ID NO:83), and the $V_{L3}$ domain comprises the amino acid sequence of DIQMTQSPSSLSASVGDRVTITCRASQNVGTAVAWYQQKPGKSPKQLIYSASNRYTGVPSR FSGSGSGTDFTLTISSLQPEDLATYYCQQYSTYPFTFGQGTKLEIK (SEQ ID NO:84);

(d) the $V_{H3}$ domain comprises the amino acid sequence of QVQLVQSGAEVKKPGASVKVSCKASGYSFTNYAVHWVRQAPGQGLEWMGVISPYYGDTT YAQKFQGRVTMTVDKSSSTAYMELSRLRSDDTAVYYCARRFEGFYYSMDYWGQGTLVTV SS (SEQ ID NO:85), and the $V_{L3}$ domain comprises the amino acid sequence of DVVMTQSPLSLPVTLGQPASISCRPSQSLVHSNGNTYLNWYQQRPGQSPKLLIYKVSKRFSG VPDRFSGSGSGTDFTLKISRVEAEDVGVYYCSQSTHVPLTFGGGTKVEIK (SEQ ID NO:86);

(e) the $V_{H3}$ domain comprises the amino acid sequence of QVQLVESGGGVVQPGRSLRLSCAASGFTFSSYGMYWVRQAPGKGLEWVAVIWYDGSNKY YADSVKGRFTISRDNSKNTLYLQMNSLRAEDTAVYHCARDPGLRYFDGGMDVWGQGTTV TVSS (SEQ ID NO:87), and the $V_{L3}$ domain comprises the amino acid sequence of DIQLTQSPSFLSASVGDRVTITCRASQGISSYLAWYQQKPGKAPKLLIFAASTLHSGVPSRFS GSGSGTEFTLTISSLQPEDFATYYCQQLNSFPYTFGQGTKLEIK (SEQ ID NO:88); or (f) the $V_{H3}$ domain comprises the amino acid sequence of QVQLVESGGGVVQPGRSLRLSCAASGFTFSSYGMHWVRQAPGKGLEWVAVIWYDGSNKY YADSVKGRFTISGDNSKNTLYLQMNSLRAEDTAVYYCARMFRGAFDYWGQGTLVTVSS (SEQ ID NO:89), and the $V_{L3}$ domain comprises the amino acid sequence of AIQMTQSPSSLSASVGDRVTITCRASQGIRNDLGWYQQKPGKAPKLLIYAASSLQSGVPSRF SGSGSGTDFTLTISGLQPEDSATYYCLQDYIYYPTFGQGTKVEIK (SEQ ID NO:90).

11. The binding protein of claim 8, wherein:

(a) the first polypeptide chain comprises the amino acid sequence of SEQ ID NO:156 or an amino acid sequence that is at least 95% identical to the amino acid sequence of SEQ ID NO:156; the second polypeptide chain comprises the amino acid sequence of SEQ ID NO:157 or an amino acid sequence that is at least 95% identical to the amino acid sequence of SEQ ID NO:157; the third polypeptide chain comprises the amino acid sequence of SEQ ID NO:158 or an amino acid sequence that is at least 95% identical to the amino acid sequence of SEQ ID NO:158; and the fourth polypeptide chain comprises the amino acid sequence of SEQ ID NO:159 or an amino acid sequence that is at least 95% identical to the amino acid sequence of SEQ ID NO:159;

(b) the first polypeptide chain comprises the amino acid sequence of SEQ ID NO:160 or an amino acid sequence that is at least 95% identical to the amino acid sequence of SEQ ID NO:160; the second polypeptide chain comprises the amino acid sequence of SEQ ID NO:161 or an amino acid sequence that is at least 95% identical to the amino acid sequence of SEQ ID NO:161; the third polypeptide chain comprises the amino acid sequence of SEQ ID NO:162 or an amino acid sequence that is at least 95% identical to the amino acid sequence of SEQ ID NO:162; and the fourth polypeptide chain comprises the amino acid sequence of SEQ ID NO:163 or an amino acid sequence that is at least 95% identical to the amino acid sequence of SEQ ID NO:163;

(c) the first polypeptide chain comprises the amino acid sequence of SEQ ID NO:164 or an amino acid sequence that is at least 95% identical to the amino acid sequence of SEQ ID NO:164; the second polypeptide chain comprises the amino acid sequence of SEQ ID NO:165 or an amino acid sequence that is at least 95% identical to the amino acid sequence of SEQ ID NO:165; the third polypeptide chain comprises the amino acid sequence of SEQ ID NO:166 or an amino acid sequence that is at least 95% identical to the amino acid sequence of SEQ ID NO:166; and the fourth polypeptide chain comprises the amino acid sequence of SEQ ID NO:167 or an amino acid sequence that is at least 95% identical to the amino acid sequence of SEQ ID NO:167;

(d) the first polypeptide chain comprises the amino acid sequence of SEQ ID NO:168 or an amino acid sequence that is at least 95% identical to the amino acid sequence of SEQ ID NO:168; the second polypeptide chain comprises the amino acid sequence of SEQ ID NO:169 or an amino acid sequence that is at least 95% identical to the amino acid sequence of SEQ ID NO:169; the third polypeptide chain comprises the amino acid sequence of SEQ ID NO:170 or an amino acid sequence that is at least 95% identical to the amino acid sequence of SEQ ID NO:170; and the fourth polypeptide chain comprises the amino acid sequence of SEQ ID NO:171 or an amino acid sequence that is at least 95% identical to the amino acid sequence of SEQ ID NO:171;

(e) the first polypeptide chain comprises the amino acid sequence of SEQ ID NO:172 or an amino acid sequence that is at least 95% identical to the amino acid sequence of SEQ ID NO:172; the second polypeptide chain comprises the amino acid sequence of SEQ ID NO:173 or an amino acid sequence that is at least 95% identical to the amino acid sequence of SEQ ID NO:173; the third polypeptide chain comprises the amino acid sequence of SEQ ID NO:174 or an amino acid sequence that is at least 95% identical to the amino acid sequence of SEQ ID NO:174; and the fourth polypeptide chain comprises the amino acid sequence of SEQ ID NO:175 or an amino acid sequence that is at least 95% identical to the amino acid sequence of SEQ ID NO:175;

(f) the first polypeptide chain comprises the amino acid sequence of SEQ ID NO:176 or an amino acid sequence that is at least 95% identical to the amino acid sequence of SEQ ID NO:176; the second polypeptide chain comprises the amino acid sequence of SEQ ID NO:177 or an amino acid sequence that is at least 95% identical to the amino acid sequence of SEQ ID NO:177; the third polypeptide chain comprises the amino acid sequence of SEQ ID NO:178 or an amino acid sequence that is at least 95% identical to the amino acid sequence of SEQ ID NO:178; and the fourth polypeptide chain comprises the amino acid sequence of SEQ ID NO:179 or an amino acid sequence that is at least 95% identical to the amino acid sequence of SEQ ID NO:179;

(g) the first polypeptide chain comprises the amino acid sequence of SEQ ID NO:181 or an amino acid sequence that is at least 95% identical to the amino acid sequence of SEQ ID NO:181; the second polypeptide chain comprises the amino acid sequence of SEQ ID NO:182 or an amino acid sequence that is at least 95% identical to the amino acid sequence of SEQ ID NO:182; the third polypeptide chain comprises the amino acid sequence of SEQ ID NO:183 or an amino acid sequence that is at least 95% identical to the amino acid sequence of SEQ ID NO:183; and the fourth polypeptide chain comprises the amino acid sequence of SEQ ID NO:184 or an amino acid sequence that is at least 95% identical to the amino acid sequence of SEQ ID NO:184; or (h) the first polypeptide chain comprises the amino acid sequence of SEQ ID NO:185 or an amino acid sequence that is at least 95% identical to the amino acid sequence of SEQ ID NO:185; the second polypeptide chain comprises the amino acid sequence of SEQ ID NO:186 or an amino acid sequence that is at least 95% identical to the amino acid sequence of SEQ ID NO:186; the third polypeptide chain comprises the amino acid sequence of SEQ ID NO:187 or an amino acid sequence that is at least 95% identical to the amino acid sequence of SEQ ID NO:187; and the fourth polypeptide chain comprises the amino acid sequence of SEQ ID NO:188 or an amino acid sequence that is at least 95% identical to the amino acid sequence of SEQ ID NO:188.

12. The binding protein of claim 1, wherein at least one of $L_1$, $L_2$, $L_3$ or $L_4$ is independently 0 amino acids in length.

13. The binding protein of claim 1, wherein (a) $L_1$, $L_2$, $L_3$ and $L_4$ each independently are zero amino acids in length or comprise a sequence selected from the group consisting of GGGGSGGGGS (SEQ ID NO:69), GGGGSGGGGSGGGGS (SEQ ID NO: 70), S, RT, TKGPS (SEQ ID NO: 68), GQPKAAP (SEQ ID NO: 67), and GGSGSSGSGG (SEQ ID NO: 71); or (b) $L_1$, $L_2$, $L_3$ and $L_4$ each independently comprise a sequence selected from the group consisting of GGGGSGGGGS (SEQ ID NO:69), GGGGSGGGGSGGGGS (SEQ ID NO:70), S, RT, TKGPS (SEQ ID NO:68), GQPKAAP (SEQ ID NO: 67), and GGSGSSGSGG (SEQ ID NO:71).

14. The binding protein of claim 1, wherein $L_1$ comprises the sequence GQPKAAP (SEQ ID NO: 67), $L_2$ comprises the sequence TKGPS (SEQ ID NO:68), $L_3$ comprises the sequence S, and $L_4$ comprises the sequence RT.

15. The binding protein of claim 1, wherein at least one of $L_1$, $L_2$, $L_3$ or $L_4$ comprises the sequence DKTHT (SEQ ID NO:66).

16. The binding protein of claim 15, wherein $L_1$, $L_2$, $L_3$ and $L_4$ comprise the sequence DKTHT (SEQ ID NO:66).

17. The binding protein of claim 1, wherein the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 234 and 235 of human IgG4 according to EU Index, wherein the amino acid substitutions are F234A and L235A.

18. The binding protein of claim 1, wherein the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 233-236 of human IgG4 according to EU Index, wherein the amino acid substitutions are E233P, F234V, L235A, and a deletion at 236.

19. The binding protein of claim 1, wherein the hinge-$C_{H2}$-$C_{H3}$ domains of the second and the third polypeptide chains are human IgG4 hinge-$C_{H2}$-$C_{H3}$ domains, and wherein the hinge-$C_{H2}$-$C_{H3}$ domains each comprise amino acid substitutions at positions corresponding to positions 228 and 409 of human IgG4 according to EU Index, wherein the amino acid substitutions are S228P and R409K.

20. The binding protein of claim 1, wherein the hinge-$C_{H2}$-$C_{H3}$ domains of the second and the third polypeptide chains are human IgG1 hinge-$C_{H2}$-$C_{H3}$ domains, and wherein the hinge-$C_{H2}$-$C_{H3}$ domains each comprise amino acid substitutions at positions corresponding to positions 234, 235, and 329 of human IgG1 according to EU Index, wherein the amino acid substitutions are L234A, L235A, and P329A.

21. The binding protein of claim 1, wherein the hinge-$C_{H2}$-$C_{H3}$ domains of the second and the third polypeptide chains are human IgG1 hinge-$C_{H2}$-$C_{H3}$ domains, and wherein the hinge-$C_{H2}$-$C_{H3}$ domains each comprise amino acid substitutions at positions corresponding to positions 298, 299, and 300 of human IgG1 according to EU Index, wherein the amino acid substitutions are S298N, T299A, and Y300S.

22. The binding protein of claim 1, wherein the hinge-$C_{H2}$-$C_{H3}$ domain of the second polypeptide chain comprises amino acid substitutions at positions corresponding to positions 349, 366, 368, and 407 of human IgG1 or IgG4 according to EU Index, wherein the amino acid substitutions are Y349C, T366S, L368A, and Y407V; and wherein the hinge-$C_{H2}$-$C_{H3}$ domain of the third polypeptide chain comprises amino acid substitutions at positions corresponding to positions 354 and 366 of human IgG1 or IgG4 according to EU Index, wherein the amino acid substitutions are S354C and T366W.

23. The binding protein of claim 1, wherein the hinge-$C_{H2}$-$C_{H3}$ domain of the second polypeptide chain comprises amino acid substitutions at positions corresponding to positions 354 and 366 of human IgG1 or IgG4 according to EU Index, wherein the amino acid substitutions are S354C and T366W; and wherein the hinge-$C_{H2}$-$C_{H3}$ domain of the third polypeptide chain comprises amino acid substitutions at positions corresponding to positions 349, 366, 368, and 407 of human IgG1 or IgG4 according to EU Index, wherein the amino acid substitutions are Y349C, T366S, L368A, and Y407V.

24. An isolated nucleic acid molecule comprising a nucleotide sequence encoding the binding protein of claim 1.

25. An expression vector comprising the nucleic acid molecule of claim 24.

26. An isolated host cell comprising the nucleic acid molecule of claim 24.

27. A pharmaceutical composition comprising the binding protein of claim 1 and a pharmaceutically acceptable carrier.

28. A vector system comprising one or more vectors encoding a first, second, third, and fourth polypeptide chain of a binding protein of claim 1.

29. The vector system of claim 28, wherein the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein.

* * * * *